US012577322B2

(12) United States Patent
Edelmann et al.

(10) Patent No.: US 12,577,322 B2
(45) Date of Patent: Mar. 17, 2026

(54) DIAGNOSTIC ANTIBODIES AGAINST MUCIN 17 AND USES THEREOF

(71) Applicant: AMGEN INC., Thousand Oaks, CA (US)

(72) Inventors: Kurt Edelmann, Thousand Oaks, CA (US); Julie Bailis, Thousand Oaks, CA (US)

(73) Assignee: AMGEN INC., Thousand Oaks, CA (US)

( * ) Notice: Subject to any disclaimer, the term of this patent is extended or adjusted under 35 U.S.C. 154(b) by 638 days.

(21) Appl. No.: 17/912,171

(22) PCT Filed: Mar. 19, 2021

(86) PCT No.: PCT/US2021/023068

§ 371 (c)(1),
(2) Date: Sep. 16, 2022

(87) PCT Pub. No.: WO2021/188851

PCT Pub. Date: Sep. 23, 2021

(65) Prior Publication Data

US 2023/0129844 A1 Apr. 27, 2023

Related U.S. Application Data

(60) Provisional application No. 63/013,259, filed on Apr. 21, 2020, provisional application No. 62/991,843, filed on Mar. 19, 2020.

(51) Int. Cl.
*C07K 16/30* (2006.01)
*G01N 33/574* (2006.01)

(52) U.S. Cl.
CPC ... *C07K 16/3092* (2013.01); *G01N 33/57446* (2013.01); *G01N 2333/4725* (2013.01)

(58) Field of Classification Search
CPC ....... C07K 16/3092; G01N 2333/4725; G01N 33/57446; A61P 35/00; A61K 2039/505
See application file for complete search history.

(56) References Cited

U.S. PATENT DOCUMENTS

| | | | |
|---|---|---|---|
| 3,773,919 | A | 11/1973 | Boswell et al. |
| 4,439,196 | A | 3/1984 | Higuchi |
| 4,447,224 | A | 5/1984 | Decant et al. |
| 4,447,233 | A | 5/1984 | Mayfield |
| 4,475,196 | A | 10/1984 | La Zor |
| 4,485,045 | A | 11/1984 | Regen |
| 4,486,194 | A | 12/1984 | Ferrara |
| 4,487,603 | A | 12/1984 | Harris |
| 4,544,545 | A | 10/1985 | Ryan et al. |
| 4,596,556 | A | 6/1986 | Morrow et al. |
| 4,694,778 | A | 9/1987 | Learn et al. |
| 4,751,180 | A | 6/1988 | Cousens et al. |
| 4,790,824 | A | 12/1988 | Morrow et al. |
| 4,816,397 | A | 3/1989 | Boss et al. |
| 4,816,567 | A | 3/1989 | Cabilly et al. |
| 4,935,233 | A | 6/1990 | Bell et al. |
| 4,941,880 | A | 7/1990 | Burns |
| 4,946,778 | A | 8/1990 | Ladner et al. |
| 5,013,556 | A | 5/1991 | Woodle et al. |
| 5,064,413 | A | 11/1991 | McKinnon et al. |
| 5,223,409 | A | 6/1993 | Ladner et al. |
| 5,225,539 | A | 7/1993 | Winter |
| 5,260,203 | A | 11/1993 | Ladner et al. |
| 5,292,658 | A | 3/1994 | Cormier et al. |
| 5,312,335 | A | 5/1994 | McKinnon et al. |
| 5,383,851 | A | 1/1995 | McKinnon et al. |
| 5,399,163 | A | 3/1995 | Peterson et al. |
| 5,418,155 | A | 5/1995 | Cormier et al. |
| 5,476,996 | A | 12/1995 | Wilson et al. |
| 5,545,806 | A | 8/1996 | Lonberg et al. |
| 5,545,807 | A | 8/1996 | Surani et al. |
| 5,565,332 | A | 10/1996 | Hoogenboom et al. |
| 5,569,825 | A | 10/1996 | Lonberg et al. |
| 5,585,089 | A | 12/1996 | Queen et al. |
| 5,591,669 | A | 1/1997 | Krimpenfort et al. |
| 5,612,205 | A | 3/1997 | Kay et al. |
| 5,625,126 | A | 4/1997 | Lonberg et al. |
| 5,625,825 | A | 4/1997 | Rostoker et al. |
| 5,633,425 | A | 5/1997 | Lonberg et al. |

(Continued)

FOREIGN PATENT DOCUMENTS

| | | |
|---|---|---|
| EP | 0088046 A2 | 9/1983 |
| EP | 0133988 A2 | 3/1985 |

(Continued)

OTHER PUBLICATIONS

Junker et al (Cancer Res (2008) 68 (9_Supplement): 1938,[Junker-1] (Year: 2008).*
Junker et al (Cancer Res (2008) 68 (9_Supplement): 78,[Junker-2] (Year: 2008).*
Allison et al, (Heterogeneity and Cancer, retrieved from: https://www.cancernetwork.com/view/heterogeneity-and-cancer (2014)) (Year: 2014).*
American Cancer Society (Can Cancer be Cured?, American Cancer Society, retrieved from: https://www.cancer.org/cancer/understanding-cancer/can-cancer-be-cured.html)(2021)) (Year: 2021).*
Can cancer be prevented/Can I make sure I don't get cancer, Cancer Research UK, obtained from: https://www.cancerresearchuk.org/about-cancer/causes-of-cancer/can-cancer-be-prevented-0#:~:text=Can%201%20make%20sure%201,a%20family%20history%20of%20cancer) (Year: 2022).*

(Continued)

*Primary Examiner* — Gregory S Emch
*Assistant Examiner* — Ashley H. Gao
(74) *Attorney, Agent, or Firm* — MARSHALL, GERSTEIN & BORUN LLP

(57) ABSTRACT

The present invention relates to antibodies that bind to human and monkey mucin 17 (MUC17). Moreover, the invention relates to a detection system comprising such antibodies. The antibodies or the detection system may be used for detecting or quantifying MUC17, for diagnosing a disease associated with MUC17, for patient stratification, monitoring disease progression, and evaluating the therapeutic response.

12 Claims, 2 Drawing Sheets

Specification includes a Sequence Listing.

(56) References Cited

U.S. PATENT DOCUMENTS

| | | | |
|---|---|---|---|
| 5,643,763 | A | 7/1997 | Dunn et al. |
| 5,648,260 | A | 7/1997 | Winter et al. |
| 5,661,016 | A | 8/1997 | Lonberg et al. |
| 5,683,888 | A | 11/1997 | Campbell |
| 5,693,761 | A | 12/1997 | Queen et al. |
| 5,693,762 | A | 12/1997 | Queen et al. |
| 5,698,767 | A | 12/1997 | Wilson et al. |
| 5,721,367 | A | 2/1998 | Kay et al. |
| 5,741,668 | A | 4/1998 | Ward et al. |
| 5,770,429 | A | 6/1998 | Lonberg et al. |
| 5,777,079 | A | 7/1998 | Tsien et al. |
| 5,789,215 | A | 8/1998 | Berns et al. |
| 5,789,650 | A | 8/1998 | Lonberg et al. |
| 5,804,387 | A | 9/1998 | Cormack et al. |
| 5,814,318 | A | 9/1998 | Lonberg et al. |
| 5,859,205 | A | 1/1999 | Adair et al. |
| 5,874,299 | A | 2/1999 | Lonberg et al. |
| 5,874,304 | A | 2/1999 | Zolotukhin et al. |
| 5,876,995 | A | 3/1999 | Bryan |
| 5,877,397 | A | 3/1999 | Lonberg et al. |
| 5,925,558 | A | 7/1999 | Tsien et al. |
| 5,939,598 | A | 8/1999 | Kucherlapati et al. |
| 5,958,765 | A | 9/1999 | Brams et al. |
| 5,981,175 | A | 11/1999 | Loring et al. |
| 6,023,010 | A | 2/2000 | Krimpenfort et al. |
| 6,075,181 | A | 6/2000 | Kucherlapati et al. |
| 6,114,598 | A | 9/2000 | Kucherlapati et al. |
| 6,150,584 | A | 11/2000 | Kucherlapati et al. |
| 6,162,963 | A | 12/2000 | Kucherlapati et al. |
| 6,255,458 | B1 | 7/2001 | Lonberg et al. |
| 6,300,064 | B1 | 10/2001 | Knappik et al. |
| 6,407,213 | B1 | 6/2002 | Carter et al. |
| 6,673,986 | B1 | 1/2004 | Kucherlapati et al. |
| 2003/0070185 | A1 | 4/2003 | Jakobovits et al. |
| 2005/0076395 | A1 | 4/2005 | Kucherlapati et al. |
| 2014/0302037 | A1 | 10/2014 | Borges et al. |
| 2014/0308285 | A1 | 10/2014 | Yan et al. |

FOREIGN PATENT DOCUMENTS

| | | | |
|---|---|---|---|
| EP | 0171496 | A2 | 2/1986 |
| EP | 0173494 | A2 | 3/1986 |
| EP | 0183070 | A2 | 6/1986 |
| EP | 0058481 | B1 | 10/1986 |
| EP | 0143949 | B1 | 10/1988 |
| EP | 0036676 | B2 | 9/1990 |
| EP | 0402226 | A1 | 12/1990 |
| EP | 0463151 | A1 | 1/1992 |
| EP | 0281604 | B1 | 3/1993 |
| EP | 0239400 | B1 | 8/1994 |
| EP | 0773288 | A2 | 5/1997 |
| EP | 0546073 | B1 | 9/1997 |
| EP | 0843961 | A1 | 5/1998 |
| EP | 0244234 | B2 | 11/2001 |
| EP | 2172483 | A1 | 4/2010 |
| GB | 2177096 | A | 1/1987 |
| JP | 3068180 | B2 | 7/2000 |
| JP | 3068506 | B2 | 7/2000 |
| JP | 3068507 | B2 | 7/2000 |
| WO | 88/01649 | A1 | 3/1988 |
| WO | 88/09344 | A1 | 12/1988 |
| WO | 91/10741 | A1 | 7/1991 |
| WO | 92/03918 | A1 | 3/1992 |
| WO | 92/15673 | A1 | 9/1992 |
| WO | 92/22645 | A1 | 12/1992 |
| WO | 92/22647 | A1 | 12/1992 |
| WO | 92/22670 | A1 | 12/1992 |
| WO | 93/12227 | A1 | 6/1993 |
| WO | 93/15722 | A1 | 8/1993 |
| WO | 94/00569 | A1 | 1/1994 |
| WO | 94/02602 | A1 | 2/1994 |
| WO | 94/25585 | A1 | 11/1994 |
| WO | 95/07463 | A1 | 3/1995 |
| WO | 96/14436 | A1 | 5/1996 |
| WO | 96/33735 | A1 | 10/1996 |
| WO | 96/34096 | A1 | 10/1996 |
| WO | 97/13852 | A1 | 4/1997 |
| WO | 97/38731 | A1 | 10/1997 |
| WO | 98/14605 | A1 | 4/1998 |
| WO | 98/24884 | A1 | 6/1998 |
| WO | 98/24893 | A2 | 6/1998 |
| WO | 98/26277 | A2 | 6/1998 |
| WO | 98/52976 | A1 | 11/1998 |
| WO | 99/49019 | A2 | 9/1999 |
| WO | 99/54440 | A1 | 10/1999 |
| WO | 00/06605 | A2 | 2/2000 |
| WO | 00/34317 | A2 | 6/2000 |
| WO | 00/76310 | A1 | 12/2000 |
| WO | 03/47336 | A2 | 6/2003 |
| WO | 2005/040220 | A1 | 5/2005 |
| WO | 2006/138181 | A2 | 12/2006 |
| WO | 2008/011956 | A1 | 1/2008 |
| WO | 2008/119567 | A2 | 10/2008 |
| WO | 2010/037838 | A2 | 4/2010 |
| WO | 2013/026833 | A1 | 2/2013 |
| WO | 2013/026837 | A1 | 2/2013 |
| WO | 2013/072406 | A1 | 5/2013 |
| WO | 2014/144722 | A2 | 9/2014 |
| WO | 2014/151910 | A1 | 9/2014 |
| WO | 2015/048272 | A1 | 4/2015 |
| WO | 2019/133961 | A1 | 7/2019 |

OTHER PUBLICATIONS

Al Qaraghuli et al. (2020, Nature Scientific Reports 10:13969) (Year: 2020).*

Rabia, et al. (2018, Biochemical Engineering Journal 137:365-374) (Year: 2018).*

Tiller et al (2017, J. Biol. Chem. (2017) 292(40) 16638-16652) (Year: 2017).*

Tsuji et al (2022, J Virol 96:e00071-22) (Year: 2022).*

Yang et al (Mucin 17 inhibits the progression of human gastric cancer by limiting inflammatory responses through a MYH9-p53-RhoA regulatory feedback loop. J Exp Clin Cancer Res 38, 283 (2019)) (Year: 2019).*

Altschul et al., Basic local alignment search tool, J. Mol. Biol., 215:403-410 (1990).

Altschul et al., Gapped Blast and PSI-Blast: a new generation of protein database search programs, Nucl. Acids Res., 25:3389-3402 (1997).

Altschul et al., Local alignment statistics, Methods Enzymol., 266:460-480 (1996).

Arakawa et al., Solvent interactions in pharmaceutical formulations, Pharm. Res., 8(3):285-91 (1991).

Artsaenko et al., The expression of a single-chain Fv antibody against abscisic acid creates a wilty phenotype in transgenic tobacco, The Plant J., 8:745-50 (1995).

Biolegend et al., Purified anti-human MUC-17 Antibody Antigen Details Structure 451 KD N-glycosylate single pass membrane protein, Bio. J. Bio. Res. Commun. Canc. Sci., XP55804156 (2018).

Bird et al., Single-chain antigen-binding proteins, Science, 242:423-426 (1988).

Bruhl et al., Depletion of CCR5-expressing cells with bispecific antibodies and chemokine toxins: a new strategy in the treatment of chronic inflammatory diseases and HIV, j. Immunol., 166:2420-2426 (2001).

Carter et al., High level *Escherichia coli* expression and production of a bivalent humanized antibody fragment, Biotechnology, 10:163-7 (1992).

Chalfie et al., Green fluorescent protein as a marker for gene expression, Science, 263:802-805 (1994).

Cheadle et al., Cloning and expression of the variable regions of mouse myeloma protein MOPC315 in *E. coli*:recovery of active FV fragments, Mol. Immunol., 29:21-30 (1992).

Cheson et al., Report of an international workshop to standardize response criteria for non-Hodgkin's lymphomas. NCI Sponsored International Working Group, J. Clin. Oncol., 17:1244 (1999).

Chothia et al., Canonical structures for the hypervariable regions of immunoglobulins, J. Mol. Biol., 196:901-917 (1987).

(56) References Cited

OTHER PUBLICATIONS

Chothia et al., Conformations of immunoglobulin hypervariable regions, Nature, 342:877-883 (1989).
Clackson et al., Making antibody fragments using phage display libraries, Nature, 352:624-628 (1991).
Cole et al., Monoclonal antibodies and cancer therapy, Alan R. Liss, Inc., 77-96 (1985).
Cook et al., The human immunoglobulin VH repertoire, Immunol. Today, 16(5):237-242 (1995).
Corfield, Biochim. Biophys. Acta., (2013).
Creighton, Proteins: Structure and Molecular Properties, W. H. Freeman & Co., San Francisco, 79-86 (1983).
Cunningham et al., High-resolution epitope mapping of hGH-receptor interactions by alanine-scanning mutagenesis, Science, 244:1081-5 (1989).
Dall'Acqua et al., Contribution of domain interface residues to the stability of antibody CH3 domain homodimers, Biochem., 37:9266-9273 (1998).
Devereux et al., A comprehensive set of sequence analysis programs for the VAX, Nucl. Acid Res., 12:387-395 (1984).
Eppstein et al., Biological activity of liposome-encapsulated murine interferon gamma is mediated by a cell membrane receptor, Proc. Natl. Acad. Sci. USA, 82(11):3688-3692 (1985).
Fecker et al., Expression of single-chain antibody fragments (scFv) specific for beet necrotic yellow vein virus coat protein or 25 kDa protein in *Escherichia coli* and Nicotiana benthamiana, Plant Mol. Biol., 32(5):979-986 (1996).
Feng et al., Progressive sequence alignment as a prerequisite to correct phylogenetic trees, J. Mol. Evol., 35:351-360 (1987).
Furuya et al., Combined evaluation of CK5/6, ER, p63, and MUC3 for distinguishing breast intraductal papilloma from ductal carcinoma in situ, Pathol. Int., 62(6):381-390 (2012).
Gabizon et al., Pharmacokinetics and tissue distribution of doxorubicin encapsulated in stable liposomes with long circulation times, J. National Cancer Inst., 81(19):1484-8 (1989).
George et al., Current methods in sequence comparison and analysis, Macromolecule Sequencing and Synthesis, Selected Methods and Applications, 127-149 (1988), Alan R. Liss, Inc.
Graham et al., Characteristics of a human cell line transformed by DNA from human adenovirus type 5, J. Gen. Virol., 36:59-74 (1977).
Green et al., Antigen-specific human monoclonal antibodies from mice engineered with human lg heavy and light chain YACs, Nat. Genet., 7:13-21 (1994).
Green et al., Regulation of B cell development by variable gene complexity in mice reconstituted with human immunoglobulin yeast artificial chromosomes, J. Exp. Med., 188:483-495 (1998).
Gum et al., MUC17, a novel membrane-tethered mucin, Biochem. Biophys. Res. Comm., 291:466-75 (2002).
Hattrup et al., Structure and function of the cell surface (tethered) mucins, Annu. Rev. Physiol., 70:431-57 (2008).
Hawkins et al., Selection of phage antibodies by binding affinity. Mimicking affinity maturation, J. Mol. Biol., 224:889-896 (1992).
Heim et al., Engineering green fluorescent protein for improved brightness, longer wavelengths and fluorescence resonance energy transfer, Curr. Biol., 6:178-182 (1996).
Hiatt et al., Production of antibodies in transgenic plants, Nature, 342:76-8 (1989).
Higgins et al., Fast and sensitive multiple sequence alignments on a microcomputer, Comp. Appl. Biosci., 5:151-153 (1989).
Hollinger et al., "Diabodies": small bivalent and bispecific antibody fragments, Proc. Nat. Acad. Sci. USA, 90(14):6444-8 (1993).
Hollingsworth et al., Mucins in cancer: protection and control of the cell surface, Nat. Rev. Cancer, 4(1):45-60 (2004).
Huston et al., Protein engineering of antibody binding sites: recovery of specific activity in an anti-digoxin single-chain Fv analogue produced in *Escherichia coli*, Proc. Natl. Acad. Sci. U.S.A., 85:5879-83 (1988).
Hwang et al., Hepatic uptake and degradation of unilamellar sphingomyelin/cholesterol liposomes: A kinetic study, Proc. Natl. Acad. Sci. U.S.A., 77:4030-4 (1980).
Ichiki et al., Regulation of the expression of human C epsilon germline transcript. Identification of a novel IL-4 responsive element, J. Immunol., 150:5408-5417 (1993).
International Application No. PCT/US2021/023068, International Preliminary Report on Patentability, mailed Sep. 29, 2022.
International Application No. PCT/US2021/023068, International Search Report and Written Opinion, mailed Jun. 9, 2021.
Johansson et al., Immunological aspects of intestinal mucus and mucins, Nat. Rev. Immunology, 16(10):639-49 (2016).
Jones et al., Replacing the complementarity-determining regions in a human antibody with those from a mouse, Nature, 321:522-525 (1986).
Karin et al., Inhibition of insulitis and prevention of diabetes in nonobese diabetic mice by blocking L-selectin and very late antigen 4 adhesion receptors, Proc. Natl. Acad. Sci. U.S.A., 90:5873-5787 (1993).
Kendrick et al., Physical stabilization of proteins in aqueous solution, Rational design of stable protein formulations: theory and practice, Pharmaceutical Biotechnology, 13:61-84 (2002).
Kipriyanov et al., Bispecific tandem diabody for tumor therapy with improved antigen binding and pharmacokinetics, J. Mol. Biol., 293:41-56 (1999).
Kohler et al., Continuous cultures of fused cells secreting antibody of predefined specificity, Nature, 256:495-497 (1975).
Kozbor et al., The production of monoclonal antibodies from human lymphocytes, Immunol. Today, 4:72-79 (1983).
Kufer et al., A revival of bispecific antibodies, Trends Biotechnol., 22(5):238-244 (2004).
Kufer et al., Construction and biological activity of a recombinant bispecific single-chain antibody designed for therapy of minimal residual colorectal cancer, Cancer Immunol. Immunother., 45:193-197 (1997).
Langer et al., Biocompatibility of polymeric delivery systems for macromolecules, J. Biomed. Mater. Res., 15(2):167-277 (1981).
Langer, Controlled release of macromolecules, Chem. Tech., 12(2):98-105 (1982).
Loffler et al., A recombinant bispecific single-chain antibody, CD19 x CD3, induces rapid and high lymphoma-directed cytotoxicity by unstimulated T lymphocytes, Blood, 95(6):2098-2103 (2000).
Lowman et al., Selecting high-affinity binding proteins by monovalent phage display, Biochemistry 30:10832-10838 (1991).
Luu et al., Human intestinal MUC17 mucin augments intestinal cell restitution and enhances healing of experimental colitis, Int. J. Biochem. Cell Biol., 42(6):996-1006 (2010).
Maccallum et al., Antibody-antigen interactions: contact analysis and binding site topography, J. Mol. Biol., 262:732-745 (1996).
Mack et al., A small bispecific antibody construct expressed as a functional single-chain molecule with high tumor cell cytotoxicity, PNAS, 92:7021-7025 (1995).
Mack et al., Biologic properties of a bispecific single-chain antibody directed against 17-1A (EpCAM) and CD3: tumor cell-dependent T cell stimulation and cytotoxic activity, J. Immunol., 158:3965-3970 (1997).
Malmborg et al., BIAcore as a tool in antibody engineering, J. Immunol. Methods, 183:7-13 (1995).
Marks et al., By-passing immunization. Human antibodies from V-gene libraries displayed on phage, J. Mol. Biol., 222:581-597 (1991).
Martin et al., Irreversible coupling of immunoglobulin fragments to preformed vesicles. An improved method for liposome targeting, J. Biol. Chem., 257:286-8 (1982).
Martin et al., Structural families in loops of homologous proteins: automatic classification, modelling and application to antibodies, J. Mol. Biol., 263:800-15 (1996).
Mather et al., Culture of testicular cells in hormone-supplemented serum-free medium, Ann. N.Y. Acad. Sci., 383:44-68 (1982).
Mather, Establishment and characterization of two distinct mouse testicular epithelial cell lines, Biol. Reprod., 23:243-51 (1980).

(56) References Cited

OTHER PUBLICATIONS

Mendez et al., Functional transplant of megabase human immunoglobulin loci recapitulates human antibody response in mice, Nature Genetics, 15:146-156 (1997).
Moehle et al., Aberrant intestinal expression and allelic variants of mucin genes associated with inflammatory bowel disease, J. Mol. Med., 84(12):1055-66 (2006).
Moniaux et al., Characterization of human mucin MUC17. Complete coding sequence and organization, J. Biol. Chem., 281(33):23676-85 (2006).
Monison et al., Combinatorial alanine-scanning, Cur. Opin. Chem. Biol., 5(3):302-7 (2001).
Morrison et al., Chimeric human antibody molecules: mouse antigen-binding domains with human constant region domains, Proc. Natl. Acad. Sci. USA, 81:6851-6855 (1984).
Morrison, Transfectomas provide novel chimeric antibodies, Science, 229:1202-1207 (1985).
Needleman et al., A general method applicable to the search for similarities in the amino acid sequence of two proteins, J. Mol. Biol., 48:443-53 (1970).
Nolan et al., Fluorescence-activated cell analysis and sorting of viable mammalian cells based on beta-D-galactosidase activity after transduction of *Escherichia coli* lacZ, Proc. Natl. Acad. Sci. USA., 85:2603-2607 (1988).
Ol et al., Chimeric antibodies, BioTechniques, 4:214-221 (1986).
Olsson et al., Human-human monoclonal antibody-producing hybridomas: technical aspects, Meth. Enzymol., 92:3-16 (1982).
Owen et al., Synthesis of a functional anti-phytochrome single-chain Fv protein in transgenic tobacco, Biotechnology, 10:790-4 (1992).
Padlan, Anatomy of the antibody molecule, Molec. Immunol., 31(3):169-217 (1993).
Pearson et al., Improved tools for biological sequence comparison, Proc. Nat. Acad. Sci. USA., 85:2444-8(1988).
Pluckthun, Antibodies from *Escherichia coli*, The Pharmacology of Monoclonal Antibodies, Rosenburg and Moore eds. Springer-Verlag, 113:269-315 (1994).
Presta, Antibody engineering, Curr. Op. Struct. Biol., 2:593-596 (1992).
Raag et al., Single-chain Fvs, Faseb, J., 9:73-80 (1995).
Randolph et al., Surfactant-protein interactions, Pharm. Biotechnol., 13:159-75 (2002).
Reichmann et al., Reshaping human antibodies for therapy, Nature, 332:323-329 (1988).
Resta-Lenert et al., Muc17 protects intestinal epithelial cells from enteroinvasive *E. coli* infection by promoting epithelial barrier integrity, Am. J. Physiology, 300(6):G1144-55 (2011).
Schier et al., Efficient in vitro affinity maturation of phage antibodies using BIAcore guided selections, Human Antibodies Hybridomas, 7:97-105 (1996).
Schlereth et al., Cancer Immunol. Immunother., 20:1-12 (2005).
Senapati et al., Expression of intestinal MUC17 membrane-bound mucin in inflammatory and neoplastic diseases of the colon, J. Clin. Pathol., 63(8):702-7 (2010).
Sidman et al., Controlled release of macromolecules and pharmaceuticals from synthetic polypeptides based on glutamic acid, Biopolymers, 22(1):547-556 (1983).
Skerra et al., Assembly of a functional immunoglobulin Fv fragment in *Escherichia coli*, Science, 242:1038-1041 (1988).
Smith et al., Comparison of biosequences , Adv. Appl. Math., 2:482-89 (1981).
Smith, Filamentous fusion phage: novel expression vectors that display cloned antigens on the virion surface, Science, 228:1315-1317 (1985).
Songsivilai et al., Bispecific antibody: a tool for diagnosis and treatment of disease, Clin. Exp. Immunol., 79(3):315-321 (1990).
Stauber et al., Development and applications of enhanced green fluorescent protein mutants, Biotechniques, 24:462-471 (1998).
Takeda et al., Construction of chimaeric processed immunoglobulin genes containing mouse variable and human constant region sequences, Nature, 314:452-4 (1985).
Teng et al., Construction and testing of mouse-human heteromyelomas for human monoclonal antibody production, Proc. Natl. Acad. Sci. USA., 80:7308-7312 (1983).
Tomlinson et al., The repertoire of human germline VH sequences reveals about fifty groups of VH segments with different hypervariable loops, J. Mol. Biol., 227:776-798 (1992).
Tomlinson et al., The structural repertoire of the human V kappa domain, Embo. J., 14:4628-4638 (1995).
Urlaub et al., Isolation of Chinese hamster cell mutants deficient in dihydrofolate reductase activity, Proc. Natl. Acad. Sci. U.S.A., 77:4216-20 (1980).
Ward et al., Binding activities of a repertoire of single immunoglobulin variable domains secreted from *Escherichia coli*, Nature, 341:544-546 (1989).

* cited by examiner

DIAGNOSTIC ANTIBODIES AGAINST MUCIN 17 AND USES THEREOF

TECHNICAL FIELD

The present invention relates to antibodies that bind to mucin 17 (MUC17). Moreover, the invention relates to a detection system comprising such antibodies. The antibodies or the detection system may be used for detecting or quantifying MUC17, for diagnosing a disease associated with MUC17, for patient stratification, monitoring disease progression, and evaluating the therapeutic response.

Mucins have been identified as interesting markers for inflammatory and cancerous diseases. Mucins are high molecular weight glycoproteins that are characterized by high levels of O-glycosylation at serine and threonine residues within tandem repeat domains (Johansson and Hansson, Nat. Rev. Immunology 2016). There are at least 20 mucin family members, including secreted proteins and transmembrane proteins, which are expressed by epithelial cells in different tissues (Corfield, Biochim. Biophys. Acta 2013). The main function of mucins is in the structure and regulation of the mucosal layer that forms a protective barrier between epithelial cells and the environment (Hollingsworth and Swanson, Nat. Rev. Cancer 2004; Hattrup and Gendler, Annu. Rev. Physiol. 2008). Transmembrane mucins also play a role in cellular signaling, including regulation of proliferation and apoptosis, and in tumorigenesis (Hollingsworth and Swanson, Nat. Rev. Cancer 2004). Among the mucins, Mucin 17 (MUC17) is a transmembrane mucin that was initially identified by its homology to MUC3 (Gum et al., Biochem. Biophys. Res. Comm 2002).

Analysis of the complete coding sequence of MUC17 revealed that it has a large extracellular domain composed of a central region of 61 tandem repeats, an epidermal growth factor (EGF) domain, a sea urchin sperm protein, enterokinase and agrin (SEA) domain, and a second EGF domain. The SEA domain contains a putative cleavage site that is conserved in other mucins (Moniaux et al., J. Biol. Chem. 2006). MUC17 is a single-pass transmembrane protein with an 80-amino acid cytoplasmic tail that is intracellular (Moniaux et al., J. Biol. Chem. 2006). The expression of MUC17 in healthy adults is restricted to the apical surface of enterocytes, or mature absorptive epithelial cells, that line the intestine (Moniaux et al., J. Biol. Chem. 2006; Johanasson and Hansson, Nat. Rev. Immunology 2016). MUC17 is also expressed by the stomach and pancreas (Moniaux et al., J. Biol. Chem. 2006; Moehle et al., J. Mol. Med. 2006). The biological function of MUC17 is considered to be the maintenance of mucosal barrier integrity in the intestinal tract, such as by mucosal restitution (Luu et al., Int. J. Biochem. Cell Biol. 2010; Resta-Lenert et al., Am. J. Physiology 2011; Johanasson and Hansson, Nat. Rev. Immunology 2016).

MUC17 is aberrantly expressed in some cancers. MUC17 mRNA was shown to be expressed in one pancreatic cancer cell line and three colon cancer cell lines (Gum et al. 2002). Immunohistochemistry studies confirmed expression of the MUC17 protein in pancreatic cancer ((Moniaux et al. 2006). In colon cancer, however, MUC17 protein expression was shown to be decreased (Senapati et al., J. Clin. Pathol. 2010). Nevertheless, the expression patterns of MUC17 make it a potential target for the treatment of different forms of malignancy. Clinical trials using anti-MUC17 antibody constructs were initiated to test their suitability for treating gastrointestinal cancer and gastroesophageal junction cancer (clinicaltrials.gov; NCT04117958).

SUMMARY

In view of the conflicting implications in the literature about MUC17 as a potential target for which pathological condition, it is the object of the present invention to clearly identify specific conditions associated with MUC17 upregulation and to provide binders (e.g. antibodies) that selectively bind MUC17 for use as diagnostic tool in a MUC17-associated condition, preferably for use in the detection/diagnosis of said specific conditions and/or in the monitoring of disease status prior to, concurrent with and subsequent to a therapeutic invention. Monitoring serves to determine the success of a given treatment and permits to the treating physician to determine as to whether the treatment is effective or is insufficient and needs to be modified.

Ideally, the diagnostic antibody binds to a region that is like the region identified or targeted by therapeutic antibody constructs. As tumor antigens can present themselves in different splice forms or may have mutations affecting the three-dimensional structure of the target it is desirable to verify that the target of the therapeutic antibody exists in a given patient and that such patient qualifies as being eligible to such treatment. When the target regions of a tumor antigen are not present in a given patient, treatment with a selectively binding therapeutic antibody construct may not be favorable in view of potential adverse events associated with the treatment. Further, patients would not be subjected to an inappropriate and potentially disadvantageous, exhausting and cost-intensive treatment and could rather be treated with alternative treatment methods that shows more promise as being effective. It should be kept in mind that patients that are subjected to immunotherapy are generally critically ill patients. Often such patients are refractory to first line therapies or have experienced relapses and/or have metastases that do not respond to the initial therapy. It is not desirable to treat such patients without having a clear diagnostic basis that a treatment with an immunotherapeutic compound is reasonable and medically founded.

Accordingly, the present invention provides an antibody binding to MUC17. The antibody may be used in diagnostic methods on tissue samples obtained from an individual, particularly from a patient suspected to have a neoplastic disease associated and/or identifiable by an aberrating MUC17 expression, e.g. a gastrointestinal cancer, pancreatic cancer, etc.

The antibody may also serve as a diagnostic tool in the detection of MUC17 in laboratory animals, for example in previously sacrificed cancer-bearing animals.

Moreover, the invention provides a polynucleotide encoding the antibody construct, a vector comprising this polynucleotide, and host cells expressing the construct as well as diagnostic compositions comprising the same and kits comprising the antibody of the present invention as diagnostic tool alongside further ingredients comprising, but not limited to, at least one of secondary antibodies, enzymes, buffers, instructions for use, tools for calibration, controls, and to forth.

EMBODIMENTS OF THE INVENTION

In a first embodiment, the present invention relates to an antibody that binds to human MUC17 as depicted in SEQ ID NO: 1, wherein said antibody binds cell surface-associated MUC17 protein.

In a second embodiment, the present invention relates to an antibody that binds to human MUC17 as depicted in SEQ ID NO: 1, wherein said antibody binds cell surface-associated MUC17 protein, wherein said antibody comprises a variable heavy chain comprising a CDR3 region depicted in SEQ ID NO: 4.

In a third embodiment, the present invention relates to an antibody according to embodiments 1 and 2, wherein said antibody further comprising the heavy chain CDR1 and CDR2 regions as depicted in SEQ ID Nos: 2 and 3 and/or the light chain CDR1, CDR2 and/or CDR3 regions depicted in SEQ ID Nos: 6, 7 and 8.

In a fourth embodiment, the present invention relates to an antibody according to any one of the preceding embodiments, wherein the monoclonal antibody comprises a VH region and/or a VL region comprised by the sequences depicted in SEQ ID NOs: 5 and 9.

In a fifth embodiment, the present invention relates to an antibody according to any one of the preceding embodiments, wherein the antibody is a monoclonal antibody.

In a sixth embodiment, the present invention relates to an antibody according to any one of the preceding embodiments, wherein the antibody specifically binds to human and cynomolgus monkey MUC17 in immunohistochemistry assays, to MUC17 expressing cells in fluorescence activated cell sorting assays, and to MUC17 expressing fixed and permeabilized cells, optionally wherein the antibody does not bind to the secreted form of huMUC17.

In a seventh embodiment, the present invention relates to an antibody according to any one of the preceding embodiments, wherein the antibody comprises a VH region comprised in SEQ ID NO: 5 and a VL region according to SEQ ID NO: 9.

In an eighth embodiment, the present invention relates to an antibody according to any one of the preceding embodiments, which is an IgG, IgD, IgE, IgM or IgA antibody, preferably an IgG antibody, such as an IgG1, IgG2, IgG3 or IgG4 antibody.

Within said embodiment, it is further envisaged in the context of the present invention to provide an antibody construct, wherein the first domain of the antibody construct binds to an epitope within MUC17 which corresponds to amino acids 4171 to 4296 according to uniprot Q685J3 numbering.

Within said embodiment, it is also envisaged in the context of the present invention to provide an antibody construct, wherein the first domain of the antibody construct binds to an epitope within MUC17 which corresponds to amino acids 4184 to 4291 according to uniprot Q685J3 numbering.

Within said embodiment, it is further envisaged in the context of the present invention to provide an antibody construct, wherein the first domain of the antibody construct binds to an epitope within MUC17 which corresponds to amino acids 4131 to 4243 according to uniprot Q685J3 numbering.

Within said embodiment, it is also envisaged in the context of the present invention to provide an antibody construct, wherein the first domain of the antibody construct binds to an epitope within MUC17 which corresponds to amino acids 4244 to 4389 according to uniprot Q685J3 numbering.

Within said embodiment, it is further envisaged in the context of the present invention to provide an antibody construct, wherein the first domain of the antibody construct binds to an epitope within MUC17 which corresponds to amino acids 4131 to 4243 according to uniprot Q685J3 numbering, but not to an epitope within MUC17 which corresponds to amino acids 4244 to 4389 according to uniprot Q685J3 numbering.

Within said embodiment, it is also envisaged in the context of the present invention to provide an antibody construct, wherein the first domain of the antibody construct binds to an epitope within MUC17 which corresponds to amino acids 4171 to 4390 according to uniprot Q685J3 numbering or amino acids 4184 to 4390 according to uniprot Q685J3 numbering but not to an epitope within MUC17 which corresponds to amino acids 4291 to 4390 according to uniprot Q685J3 numbering or to an epitope within MUC17 which corresponds to amino acids 4341 to 4390 according to uniprot Q685J3 numbering.

In a ninth embodiment, the present invention relates to a polynucleotide encoding an antibody as defined in any one of the preceding embodiments.

In a tenth embodiment, the present invention relates to vector comprising the polynucleotide as defined in embodiment nine.

In an $11^{th}$ embodiment, the present invention relates to host cells transformed or transfected with the polynucleotide as defined in the tenth embodiment or with the vector as defined in ninth embodiment.

In a 12th embodiment, the present invention relates to a process for producing an antibody as defined in any one of embodiments one to eight, said process comprising culturing a host cell as defined in embodiment ten under conditions allowing the expression of said antibody and recovering the produced antibody from the culture.

In a 13th embodiment, the present invention relates to hybridoma producing the antibody according to any one of the preceding embodiments one through eight.

In a $14^{th}$ embodiment, the present invention relates to a composition comprising an antibody as defined in any one of embodiments one to eight, or as produced according to the process of the $12^{th}$ embodiment.

In a $15^{th}$ embodiment, the present invention relates to a detection system comprising the antibody as defined in any one of embodiments 1 to 8, or as produced according to the process of embodiment 12.

In a $16^{th}$ embodiment, the present invention relates to a use of an antibody as defined in any one of embodiment 1-8 or as produced according to the process of embodiment 12 or of the detection system of embodiment 15 in a diagnostic method.

In a $17^{th}$ embodiment, the present invention relates to an antibody as defined in any one of embodiment 1-8 or as produced according to the process of embodiment 12, the composition of embodiment 14, or of the detection system of embodiment 15 for use in a method of detecting neoplastic growth.

In an $18^{th}$ embodiment, the present invention relates to the antibody or detection system for use according to embodiment 17 in a method of detecting neoplastic growth comprising determining the quantity of expression of MUC17 in a sample from a patient suspected to suffer from a cancer and in a negative control sample and, optionally, in a positive control sample.

In a $19^{th}$ embodiment, the present invention relates to the antibody or detection system for use according to any one of embodiment 17 and 18 in a method of detecting neoplastic growth comprising determining the quantity of expression of MUC17 in a sample from a patient suspected to suffer from a cancer and in a negative control sample, further comprising comparing the expression quantities of MUC17 between the samples, optionally wherein the expression quantities in the negative control and/or the positive control may be derived from stored data in at least one negative control sample and/or at least one positive control sample obtained in a method of detecting neoplastic growth comprising determining the quantity of expression of MUC17, further optionally, wherein the expression quantities in the negative control sample and/or the positive control sample may be derived from stored data comprising averaged expression quantities of more than one negative control sample and/or more than one positive control sample obtained in a method of detecting neoplastic growth comprising determining the quantity of expression of MUC17.

In a 20$^{th}$ embodiment, the present invention relates to the antibody or detection system for use according to any one of embodiment 17 and 19 in a method of detecting neoplastic growth comprising determining the quantity of expression of MUC17 in a sample, wherein the sample is either a solid tissue sample or a liquid tissue sample.

In a 21$^{th}$ embodiment, the present invention relates to a method for detecting and/or quantifying MUC17 expression in a sample, comprising the steps of:

(a) using an antibody as defined in or produced according to any one of the preceding embodiments, or using a detection system of embodiment 15, for determining the expression quantity of MUC17 in a sample; and
(b) comparing the expression quantity of MUC17 determined in step (a) to
(c) a pre-defined value for the MUC17 expression quantity,
(d) the expression quantity of MUC17 determined in a control sample, or
(e) the expression quantity of MUC17 determined in a sample obtained from the same source or subject at a previous time point.

In a 22nd embodiment, the present invention relates to a method for diagnosing a neoplastic disease associated with expression quantity of MUC17 or increased expression quantity of MUC17, comprising the steps of:

(a) using an antibody as defined in or produced according to any one of embodiment, or using a detection system of embodiment 15, for determining the expression quantity of MUC17 in a sample; and
(b) comparing the expression quantity of MUC17 determined in step (a) to
(c) a pre-defined cut-off value for the expression quantity of MUC17, indicating absence of such disease, or
(d) the expression quantity of MUC17 determined in a negative control sample representing absence of such neoplastic disease, wherein a higher expression quantity of MUC17 determined in step (a) as compared to the pre-defined cut-off value of (i) or the expression quantity of MUC17 determined in the negative control sample of (ii) indicates the presence of a disease associated with expression of MUC17 or increased expression quantity of MUC17.

In a 23rd embodiment, the present invention relates to a method for monitoring the progression of a disease associated with expression of MUC17 or with increased expression quantity of MUC17 or for monitoring the response to treatment of a disease associated with expression of MUC17 or with increased expression quantity of MUC17, comprising the steps of:

(a) using an antibody as defined in any one of the preceding embodiments, or using a detection system of embodiment 15, for determining the expression quantity of MUC17 at a first time point in a sample obtained from a subject diagnosed with such disease;
(b) using an antibody as defined in any one of the preceding embodiments, or using a detection system of embodiment 15, for determining the expression quantity of MUC17 at a second time point or after treatment in a sample obtained from the subject; and
(c) comparing the expression quantity of MUC17 determined in step (a) to the expression quantity of MUC17 determined in step (b);

wherein a higher expression quantity of MUC17 determined in step (a) as compared to the expression quantity of MUC17 determined in step (b) indicates that the disease is progressing, and/or wherein a lower expression quantity of MUC17 determined in step (a) as compared to the expression quantity of MUC17 determined in step (b) indicates that said disease is entering remission or that said disease is responding to the treatment.

In a 24$^{th}$ embodiment, the present invention relates to the use or the product for use of any one of embodiments 16 to 20 or the method of any one of embodiment 21 to 23, wherein the sample is a biological sample, preferably a human biological sample, such as a tissue sample, or a sample comprising cultured cells.

In a 25$^{th}$ embodiment, the present invention relates to the use or the product for use of any one of embodiment 16 to 20 or the method of any one of embodiment 21 to 24, wherein the sample is obtained from a human subject, preferably a human subject suspected of having or having a disease associated with expression of MUC17 or increased expression quantity of MUC17, or a subject having received treatment for a disease associated with expression of MUC17 or increased expression quantity of MUC17.

In a 26$^{th}$ embodiment, the present invention relates to the use or the product for use of any one of embodiment 16 to 20 or the method of any one of embodiment 21 to 25, wherein the disease is selected from the group comprising esophageal cancer, gastric cancer, gastroesophageal cancer (including gastroesophageal junction cancer, GJC) gastrointestinal cancer, and pancreas cancer.

In a 27$^{th}$ embodiment, the present invention relates to the use of the any of the products as defined herein above for the detection of MUC17 expression in a immunohistochemical method (IHC method) comprising the steps of providing a sample of a tissue (including a liquid biopy material, e.g. cells obtained from an individual or animal or from cell culture). The sample material is generally provided on a support, e.g. a carrier such as a glass or plastic slide. The tissue may be fixed using fixation media known in the art such as paraffin, ethanol, or acetone, or any other suitable medium that ensure fixation of a tissue or cells on a support. The sample are subsequently prepared, e.g. deparaffinated, incubated with media permitting access of the herein described antibodies to the target of interest, here MUC17. The tissues are subsequently incubated with a medium comprising a sufficient amount of the antibodies disclosed herein to allow these antibodies to bind to MUC17 that is present in the tissue sample. After a commonly known and reasonable amount of time the incubation of the tissue with the antibody is stopped, generally by washing the support and tissue in a medium such as PBS. Both, incubation steps and washing steps may be performed at room temperature, but elevated temperatures or lower temperatures, e.g. from 2-50° C. are possible. Generally, the incubation temperature depends on the duration of the incubation time. For example, it is possible to stain tissues overnight at 4° C., but it is equally possible to shorten the incubation time to only a few minutes at higher temperatures, e.g., at about 30 to 40° C., e.g. at 37° C. To check the influence of the incubation media, fixation medium, the incubation time and temperature, tests are usually performed with positive control material that are known to express the target (here MUC17), and with negative controls of sample that are known as not expressing MUC17. A negative control may also (optionally, additionally) be performed using the antibody product of the present invention, and blocking epitopes, i.e. epitopes that correspond to those that are recognized or bound specifically/selectively by the herein described antibodies. These blocking epitopes are added in a titration assay to a positive control material. A concentration of the epitopes that prevent the antibody of the present invention to specifically and/or selectively detect MUC17 may thus be determined. This way, a positive control—in the presence of the blocking epitope—no longer serves as positive control, because the amount of antibody binding MUC17 is blocked by a sufficient amount of blocking epitopes that saturate the antibodies. Determining the correct amount of blocking epitopes and antibodies to conduct appropriate positive and negative controls is a matter known to a person skilled in the technique of immunocytochemistry and particularly immunohistochemistry. Once the appropriate controls are available, the test material, e.g. materials obtained from a patient suspected to suffer from a disease, e.g. cancer, that may be characterized by a pathologically enhanced/distributed MUC17 expression, may be analyzed. As discussed further below, the antibodies may carry a detectable label, or they may be recognized by another binder that carries such a label. The terms for these techniques are known as direct immunocytologic/immunohistochemical detection and indirect immunocytologic/immunohistochemical detection to a person skilled in the art. Once the tissue samples and controls were subjected to the required incubation steps and washing steps, the tissues are prepared for analysis, e.g. using immunofluorescence-based detection systems. The intensity and number of detectable label may be determined and compared with the positive and negative controls, and/or with known standard values. Based thereon, scientists are capable of concluding as to whether or not a sample is MUC17 expression positive.

DEFINITIONS

Figure 1A:
FIGS. 1A-C show that MUC17 is highly expressed in gastric cancer via immunohistochemistry. Immunohistochemistry using the antibody as described herein reveals multifocal, diffuse MUC17 staining (brown stain) in human metastatic gastric cancer tissue sections (FIGS. 1A-B), whereas MUC17 expression is confined to the apical membrane in normal human gastrointestinal tract, i.e., enterocytes (FIG. 1C).

Therefore, the present invention provides in one aspect an antibody (or a part or a derivative thereof) that binds to MUC17. In the following, whenever the term "antibody" is used (i.e. antibody that binds to MUC17), the term is meant to also encompass "antibody fragments", as they will be defined herein below. Furthermore, the below provided definitions and specifications of the "antibody of the present invention (e.g. a monoclonal antibody that binds to MUC17) similarly apply any antibody that is chemically or enzymatically modified, for example an antibody that carries a label such as a fluorescent, radioactive, luminescent, or colorigenic label, or an enzyme that is capable of producing a detectable signal. A "detectable signal" means that a measurement of the intensity of the label on the MUC17 antibody is possible using methods known in the art.

An "antibody" (sometimes also known as an immunoglobulin) is a protein that immunospecifically binds to its target. The antibody recognizes a unique target, called an antigen, via its variable regions. An "antibody" may be of any immunoglobulin isotype, including IgG (including IgG1, IgG2, IgG3 and IgG4 subtypes), IgA (including IgA1 and IgA2 subtypes), IgM and IgE. The term "antibody" may include, for instance, monoclonal, chimeric, recombinant, deimmunized, affinity matured, humanized and human antibodies, as well as antibodies from other species such as rodent, rabbit, mouse, rat, hamster, goat etc. Antibodies may be derived solely from a single source, or may be "chimeric," that is, different portions of the antibody (such as CDRs, framework regions, variable region, constant region) may be derived from two different antibodies. The definition of "antibody" according to the invention comprises full-length antibodies, also including camelid antibodies, and other immunoglobulins generated by biotechnological or protein engineering methods or processes. An antibody may also be produced in hybridomas.

An intact IgG antibody generally will comprise two full-length heavy chains and two full-length light chains. A "light chain" includes a variable region ("VL") having one domain, and a constant region ("CL") having one domain. The variable region of the light chain is at the amino-terminus of the polypeptide. Light chains include kappa chains and lambda chains. A "heavy chain" includes a variable region ("VH") having one domain, and a constant region ("CH") having—in the case of an intact IgG antibody—three domains: CH1, CH2, and CH3. The VH is at the amino-terminus of the polypeptide, and the CH domains are at the carboxyl-terminus, with the CH3 being closest to the carboxy-terminus of the polypeptide.

In a classical full-length antibody or immunoglobulin, each light (L) chain is linked to a heavy (H) chain by one covalent disulfide bond, while the two H chains are linked to each other by one or more disulfide bonds depending on the H chain isotype. The heavy chain constant (CH) domain most proximal to VH is usually designated as CH1. The constant ("C") domains are not directly involved in antigen binding, but exhibit various effector functions, such as antibody-dependent cell-mediated cytotoxicity (ADCC) and complement activation (complement dependent cytotoxicity, CDC). The Fc region of an antibody is the "tail" region of a classical antibody that interacts with cell surface receptors called Fc receptors and some proteins of the complement system. In IgG, IgA and IgD antibody isotypes, the Fc region is composed of two identical protein fragments, derived from the second and third constant domains (CH2 and CH3) of the antibody's two heavy chains. IgM and IgE Fc regions contain three heavy chain constant domains (CH2, CH3 and CH4) in each polypeptide chain. The Fc regions also contains part of the so-called "hinge" region held together by one or more disulfides and noncovalent interactions. The Fc region of a naturally occurring IgG bears a highly conserved N-glycosylation site. Glycosylation of the Fc fragment is essential for Fc receptor-mediated activity.

It is envisaged that the monoclonal antibody of the present invention may be an IgG, IgD, IgE, IgM or IgA antibody. According to one embodiment, the monoclonal antibody is an IgG antibody, such as an IgG1, IgG2, IgG3 or IgG4 antibody. The isotype and subclass of the antibody may be of rat, mouse, hamster, etc. (e.g. mouse IgG, mouse IgG1 etc.).

In the context of the present invention, the term "variable" refers to those portions of antibody or immunoglobulin domains that exhibit variability in their sequence and that are involved in determining the specificity and binding affinity of a particular antibody (i.e., the "variable region(s)"). Usually, the pairing of a heavy chain variable region (VH) and a light chain variable region (VL) together forms a single antigen-binding site. Variability is not evenly distributed throughout the variable regions of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable regions are called the "framework" (FR) regions and provide a scaffold for the six CDRs in three-dimensional space to form an antigen-binding surface. The variable regions of naturally occurring antibody heavy and light chains each comprise four FR regions (FR1, FR2, FR3, and FR4), largely adopting a β-sheet configuration. Together with the CDRs, they form the following sequence within a variable heavy or light chain: FR1-CDR1-FR2-CDR2-FR3-CDR3-FR4. The hypervariable regions in each chain are held together in close proximity by the framework regions and, usually together with the hypervariable regions from the other chain, contribute to the formation of the antigen-binding site (see Kabat et al., Sequences of Proteins of Immunological Interest. Bethesda, National Institute of Health. 1991).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody (or or binding domain) with the antigen and hence contribute to the functional activity of an antibody molecule: they are the main determinants of antigen specificity. The exact definition of CDR boundaries and lengths is subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mob. Biol, 1987, 196: 901-917; and MacCallum et al., J. Mol. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Corresponding loops between antibodies may, therefore, have very similar three-dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable region in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate class sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibodies, or binding domains, the heavy chain CDR3 appears to constitute the major area of contact between the antigen and the antibody. In vitro selection schemes in which CDR3 alone is varied can be used to vary the binding properties of an antibody/binding domain or determine which residues contribute to the binding of an antigen. Hence, CDR3 is typically the greatest source of molecular diversity within the antibody binding site. CDR-H3, for example, can be as short as two amino acid residues or greater than 26 amino acids.

The sequence of antibody genes after assembly and somatic mutation is highly varied, and these varied genes are estimated to encode 1010 different antibody molecules (Immunoglobulin Genes, 2nd ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The antibodies of the present invention are envisaged to be monoclonal. As used herein, antibodies or binding domains that are denominated "monoclonal" (mAb) are obtained from a population of substantially homogeneous antibodies or binding domains, i.e., the individual antibodies or binding domains comprised in the population are identical (in particular with respect to their amino acid sequence) except for possible naturally occurring mutations and/or post-translational modifications (e.g., isomerizations, amidations) that may be present in minor amounts. Monoclonal antibodies or binding domains are highly specific, being directed against a single epitope within the antigen, in contrast to polyclonal antibody preparations which typically include different antibodies directed against different determinants (or epitopes). In addition to their specificity, monoclonal antibodies are advantageous in that they are synthesized by the hybridoma culture, hence uncontaminated by other immunoglobulins. The modifier "monoclonal" indicates the character of the antibodies or binding domains as being obtained from a substantially homogeneous population of antibodies or binding domains and is not to be construed as requiring production of the antibody by any particular method.

For the preparation of monoclonal antibodies, any technique providing antibodies produced by continuous cell line cultures can be used. For example, monoclonal antibodies or binding domains to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibodies or binding domains that immunospecifically binds to a specified antigen. Any form of the relevant antigen may be used as the immunogen, e.g., recombinant antigen, naturally occurring forms, chimeric antigens, any variants or fragments of the antigen, as well as an antigenic peptide thereof. Surface plasmon resonance as employed in the BIAcore™ system can be used to increase the efficiency of phage antibodies or binding domains which bind to an epitope of a target antigen (Schier, Human Antibodies Hybridomas 7 (1996), 97-105; Malmborg, J. Immunol. Methods 183 (1995), 7-13).

Another exemplary method of making antibodies or binding domains includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., Xenomouse™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibodies, constructs or binding domains include humanized variants of non-human antibodies/s, "affinity matured" antibodies, constructs or binding domains (see, e.g. Hawkins et al. J. Mol. Biol. 254, 889-896 (1992) and Lowman et al., Biochemistry 30, 10832-10837 (1991)) and antibody variants or mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody fragments, antibody variants, or binding domains. Random mutations inside the CDRs are introduced using radiation, chemical mutagens or error-prone PCR. In addition, the genetic diversity can be increased by chain shuffling. Two or three rounds of mutation and selection using display methods like phage display usually results in antibodies, antibody fragments, antibody variants, or binding domains with affinities in the low nanomolar range.

Amino acid sequence modifications of the antibodies described herein are also contemplated. For example, it may be desirable to improve the binding affinity and/or other biological properties of the antibody Amino acid sequence variants of the antibody are prepared by peptide synthesis or by introducing appropriate nucleotide changes into the nucleic acid molecule encoding the antibodies. All below described amino acid sequence modifications should result in antibodies which retain the desired biological activity of the unmodified parental molecule (binding to MUC17).

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (Ile or I): leucine (Leu or L); lysine (Lys or K); methionine (Met or M); phenylalanine (Phe or F); proline (Pro or P); serine (Ser or S); threonine (Thr or T); tryptophan (Trp or W); tyrosine (Tyr or Y); and valine (Val or V), although modified, synthetic, or rare amino acids may be used as desired. There are basically four different classes of amino acids determined by different side chains:

(1) non-polar and neutral (uncharged): Ala, Gly, Ile, Leu, Met, Phe, Pro, Val
(2) polar and neutral (uncharged): Asn, Cys (being only slightly polar), Gln, Ser, Thr, Trp (being only slightly polar), Tyr
(3) acidic and polar (negatively charged): Asp and Glu
(4) basic and polar (positively charged): Arg, His, Lys Hydrophobic amino acids can be divided according to whether they have aliphatic or aromatic side chains. Phe and Trp (being very hydrophobic), Tyr and His (being less hydrophobic) are classified as aromatic amino acids. Strictly speaking, aliphatic means that the side chain contains only hydrogen and carbon atoms. By this strict definition, the amino acids with aliphatic side chains are alanine, isoleucine, leucine (also norleucine), proline and valine. Alanine's side chain, being very short, means that it is not particularly hydrophobic, and proline has an unusual geometry that gives it special roles in proteins. It is often convenient to consider methionine in the same category as isoleucine, leucine and valine, although it also contains a sulfur atom. The unifying theme is that these amino acids contain largely non-reactive and flexible side chains. The amino acids alanine, cysteine, glycine, proline, serine and threonine are often grouped together since they are all small. Gly and Pro may influence chain orientation.

Amino acid modifications include, for example, deletions of residues from, insertions of residues into, and/or substitutions of residues within the amino acid sequences of the monoclonal antibodies or binding domains. Any combination of deletion, insertion, and/or substitution is made to arrive at a final monoclonal antibody or binding domains, provided that the final antibody possesses the desired characteristics, e.g. the biological activity of the unmodified parental molecule (such as binding MUC17). The amino acid changes may also alter post-translational processes of the antibodies, such as changing the number or position of glycosylation sites.

For example, 1, 2, 3, 4, 5, or 6 amino acids may be inserted, deleted and/or substituted in each of the CDRs (of course, dependent on their respective length), while 1, 2, 3, 4, 5, 6, 7, 8, 9, 10, 11, 12, 13, 14, 15, 16, 17, 18, 19, 20, or 25 amino acids may be inserted, deleted and/or substituted in each of the FRs Amino acid sequence insertions also include N-terminal and/or C-terminal additions of amino acids ranging in length from e.g. 1, 2, 3, 4, 5, 6, 7, 8, 9 or 10 residues to polypeptides containing more than 10, e.g. one hundred or more residues, as well as intra-sequence insertions of single or multiple amino acid residues.

The sites of greatest interest for amino acid modifications, particularly for amino acid substitutions, include the hypervariable regions, in particular the individual CDRs of the heavy and/or light chain, but FR alterations in the heavy and/or light chain are also contemplated herein. The substitutions can be conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR, respectively. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for the identification of certain residues or regions within the monoclonal antibody or binding domains that are preferred locations for mutagenesis is called "alanine scanning mutagenesis" and is described e.g. in Cunningham B. C. and Wells J. A. (Science. 1989 Jun. 2;244(4908):1081-5). Here, a residue or group of residues within the antibody is/are identified (e.g. charged residues such as Arg, His, Lys, Asp, and Glu) and replaced by a neutral or non-polar amino acid (most preferably alanine or polyalanine) to affect the interaction of the respective amino acid(s) with the epitope of the target protein. Alanine scanning is a technique used to determine the contribution of a specific residue to the stability or function of given protein. Alanine is used because of its non-bulky, chemically inert, methyl functional group that nevertheless mimics the secondary structure preferences that many of the other amino acids possess. Sometimes bulky amino acids such as valine or leucine can be used in cases where conservation of the size of mutated residues is needed. This technique can also be useful to determine whether the side chain of a specific residue plays a significant role in bioactivity. Alanine scanning is usually accomplished by site-directed mutagenesis or randomly by creating a PCR library. Furthermore, computational methods to estimate thermodynamic parameters based on theoretical alanine substitutions have been developed. The data can be tested by IR/NMR Spectroscopy, mathematical methods, bioassays, etc.

Those amino acid locations demonstrating functional sensitivity to the substitutions (as determined e.g. by alanine scanning) can then be refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning, or random mutagenesis may be conducted at a target codon or region, and the expressed monoclonal antibody/variants are screened for the optimal combination of desired activity. Techniques for making substitution mutations at predetermined sites in the DNA having a known sequence are well known, for example, M13 primer mutagenesis and PCR mutagenesis. Screening of the mutants is done e.g. using assays of antigen (e.g. MUC17) binding activity as described herein.

Generally, if amino acids are substituted in one or more or all the CDRs of the heavy and/or light chain/variable regions, it is envisaged that the then-obtained "substituted" sequence is at least 60% or 65%, more preferably 70% or 75%, even more preferably 80% or 85%, and particularly preferably 90% or 95% identical/homologous/similar to the "original" or "parental" CDR sequence. This means that the degree of identity/homology/similarity between the original and the substituted sequence depends on the length of the CDR. For example, a CDR having 5 amino acids in total and comprising one amino acid substitution is 80% identical to the "original" or "parental" CDR sequence, while a CDR having 10 amino acids in total and comprising one amino acid substitution is 90% identical to the "original" or "parental" CDR sequence. Accordingly, the substituted CDRs of the monoclonal antibody of the invention may have different degrees of identity to their original sequences, e.g., CDRL1 may have 80%, while CDRL3 may have 90% of homology. The same considerations apply to the framework regions and to the entire VH and VL regions.

A "variant CDR" is a CDR with a specific sequence homology, similarity, or identity to the parent CDR of the invention, and shares biological function with the parent CDR, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR. Generally, the amino acid homology, similarity, or identity between individual variant CDRs is at least 60% to the parent sequences depicted herein, and more typically with increasing homologies, similarities or identities of at least 65% or 70%, preferably at least 75% or 80%, more preferably at least 85%, 90%, 91%, 92%, 93%, 94%, and most preferably 95%, 96%, 97%, 98%, 99%, and almost 100%. The same applies to "variant VH" and "variant VL". According to one embodiment, the sequence variations within a "variant VH" and/or a "variant VL" do not extend to the CDRs. The present invention is hence directed to n antibody or derivative or fragment as defined herein, comprising VH and VL sequences having a certain sequence homology/identity/similarity (see above) to the specific sequences as defined herein (the "parental" VH and VL), wherein the CDR sequences are 100% identical to the specific CDR sequences as defined herein (the "parental" CDRs).

Preferred substitutions (or replacements) are conservative substitutions. However, any substitution (including non-conservative substitutions or one or more from the "exemplary substitutions" listed in Table 1, below) is envisaged, as long as the monoclonal antibody ( ) retains its capacity to bind to MUC17, and/or provided its CDRs, FRs, VH and/or VL sequences have a degree of identity to the original or parental sequence of at least 60% or 65%, more preferably at least 70% or 75%, even more preferably at least 80% or 85%, and particularly preferably at least 90% or 95%.

A conservative replacement (also called a conservative mutation or a conservative substitution) is an amino acid replacement that changes a given amino acid to a different amino acid with similar biochemical properties (e.g. charge, hydrophobicity, size). Conservative replacements in proteins often have a smaller effect on protein function than non-conservative replacements. Conservative substitutions are shown in Table 1. Exemplary conservative substitutions are shown as "exemplary substitutions". If such substitutions result in a change in biological activity, then more substantial changes, as further described herein with respect to amino acid classes, may be introduced and the products screened for a desired characteristic.

TABLE 1

Amino acid substitutions (aa = amino acid)

| Original aa | Conservative substitutions | Exemplary Substitutions |
|---|---|---|
| Ala (A) | Small aa | Gly, Ser, Thr |
| Arg (R) | Polar aa, in particular Lys | Lys, Gln, Asn |
| Asn (N) | Polar aa, in particular Asp | Asp, Gln, His, Lys, Arg |
| Asp (D) | Glu or other polar aa, in particular Asn | Glu, Asn |
| Cys (C) | Small aa | Ser, Ala |
| Gln (Q) | Polar aa, in particular Glu | Glu, Asn |
| Glu (E) | Asp or other polar aa, in particular Gln | Asp, Gln |
| Gly (G) | Small aa, such as Ala | Ala |
| His (H) | | Asn, Gln, Arg, Lys, Tyr |
| Ile (I) | Hydrophobic, in particular aliphatic aa | Ala, Val, Met, Leu, Phe |
| Leu (L) | Hydrophobic, in particular aliphatic aa | Norleucine, Ile, Ala, Val, Met |
| Lys (K) | Polar aa, in particular Arg | Arg, Gln, Asn |
| Met (M) | Hydrophobic, in particular aliphatic aa | Leu, Ala, Ile, Val, Phe |
| Phe (F) | Aromatic or hydrophobic aa, in particular Tyr | Tyr, Trp, Leu, Val, Ile, Ala |

TABLE 1-continued

Amino acid substitutions (aa = amino acid)

| Original aa | Conservative substitutions | Exemplary Substitutions |
|---|---|---|
| Pro (P) | Small aa | Ala |
| Ser (S) | Polar or small aa, in particular Thr | Thr |
| Thr (T) | Polar aa, in particular Ser | Ser |
| Trp (W) | Aromatic aa | Tyr, Phe |
| Tyr (Y) | Aromatic aa, in particular Phe | Phe, Trp, Thr, Ser |
| Val (V) | Hydrophobic, in particular aliphatic aa | Leu, Ile, Ala, Met, Phe |

Substantial modifications in the biological properties of the antibody of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Non-conservative substitutions will usually entail exchanging a member of one of the above defined amino acid classes (such as polar, neutral, acidic, basic, aliphatic, aromatic, small . . . ) for another class. Any cysteine residue not involved in maintaining the proper conformation of the antibody may be substituted, generally with serine, to improve the oxidative stability of the antibody.

Sequence identity, homology and/or similarity of amino acid sequences is determined by using standard techniques known in the art, including, but not limited to, the local sequence identity algorithm of Smith and Waterman, 1981, Adv. Appl. Math. 2:482, the sequence identity alignment algorithm of Needleman and Wunsch (J Mol Biol. 1970 March; 48(3):443-53), the search for similarity method of Pearson and Lipman (Proc Natl Acad Sci USA. 1988 April; 85(8):2444-8), computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al. (Nucleic Acids Res. 1984 Jan. 11; 12(1 Pt 1):387-95), preferably using the default settings, or by inspection. It is envisaged that percent identity is calculated by FastDB based upon the following parameters: mismatch penalty of 1; gap penalty of 1; gap size penalty of 0.33; and joining penalty of 30. See also "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng and Doolittle (J Mol Evol. 1987; 25(4):351-60); the method is similar to that described by Higgins and Sharp (Comput Appl Biosci. 1989 April; 5(2):151-3). Useful PILEUP parameters include a default gap weight of 3.00, a default gap length weight of 0.10, and weighted end gaps.

Another example of a useful algorithm is the BLAST algorithm, described in: Altschul et al. (J Mol Biol. 1990 Oct. 5; 215(3):403-10); Altschul et al., (Nucleic Acids Res. 1997 Sep. 1; 25(17):3389-402); and Karlin and Altschul (Proc Natl Acad Sci USA. 1993 Jun. 15;90(12):5873-7). A particularly useful BLAST program is the WU-Blast-2 program which was obtained from Altschul et al., (Methods Enzymol. 1996; 266:460-80). WU-Blast-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al. (Nucleic Acids Res. 1997 Sep. 1; 25(17):3389-402). Gapped BLAST uses BLOSUM-62 substitution scores; threshold T parameter set to 9; the two-hit method to trigger non-gapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

In line herewith, the term "percent (%) nucleic acid sequence identity/homology/similarity" with respect to the nucleic acid sequence encoding the monoclonal antibodies (s) identified herein is defined as the percentage of nucleotide residues in a candidate sequence that are identical with the nucleotide residues in the coding sequence of the antibody. One method to align two sequences and thereby determine their homology uses the BLASTN module of WU-Blast2 set to the default parameters, with overlap span and overlap fraction set to 1 and 0.125, respectively. Generally, the nucleic acid sequence homology, similarity, or identity between the nucleotide sequences encoding individual variant CDRs and the nucleotide sequences depicted herein are at least 60%, and more typically with increasing homologies, similarities or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Again, the same applies to nucleic acid sequence encoding the "variant VH" and/or "variant VL".

The term "antibody derivative" according to the present invention may also comprise fragments of full-length antibodies, such as VH, VHH, VL, (s)dAb, Fv, light chain (VL-CL), Fd (VH-CH1), heavy chain, Fab, Fab', F(ab')2 or "r IgG" ("half antibody" consisting of a heavy chain and a light chain). An antibody fragment may be produced by enzymatic or chemical cleavage of intact antibodies. s according to the invention may also comprise modified fragments of antibodies, also called antibody variants or antibody derivatives. Examples include, but are not limited to, scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2, ((scFv)2-CH3+CH3), ((scFv)2-CH3) or (scFv-CH3-scFv)2, multibodies such as triabodies or tetrabodies, and single domain antibodies such as nanobodies or single variable domain antibodies comprising merely one variable region, which might be VHH, VH or VL, that specifically binds to an antigen or target independently of other variable regions or domains. Further possible formats of the s according to the invention are cross bodies, maxi bodies, hetero Fc constructs, mono Fc constructs and scFc constructs. Examples for those formats will be described herein below. Moreover, the definition of the term "antibody" includes molecules consisting of only one polypeptide chain as well as molecules consisting of two, three, four or more polypeptide chains, which chains can be either identical (homodimers, homotrimers or homo oligomers) or different (heterodimer, heterotrimer or heterooligomer). Examples for the above identified antibodies and their fragments, variants, derivatives and binding domains derived therefrom are described inter alia in Harlow and Lane, Antibodies: A laboratory manual, CSHL Press (1988); Kontermann and Dübel, Antibody Engineering, Springer, 2nd ed. 2010; and Little, Recombinant Antibodies for Immunotherapy, Cambridge University Press 2009.

The term "binding domain" or "domain which binds to . . . " characterizes in connection with the present invention a domain of the antibody which specifically binds to/interacts with/recognizes an epitope on the target or antigen (here: MUC17). The structure and function of a binding domain is/are based on the structure and/or function of an antibody, e.g. of a full-length immunoglobulin molecule. The "binding domain" or "domain which binds to . . . " may hence comprise the minimum structural requirements of an antibody which allow for immunospecific target binding. This minimum structural requirement of a binding domain may e.g. be defined by the presence of at least three light chain CDRs (i.e. CDR1, CDR2 and CDR3 of the VL region) and/or of three heavy chain CDRs (i.e. CDR1, CDR2 and CDR3 of the VH region), preferably of all six CDRs. A "domain which binds to" (or a "binding domain") may typically comprise an antibody light chain variable region (VL) and an antibody heavy chain variable region (VH); however, it does not have to comprise both, but may comprise only one of VH or VL. Fd fragments, for example, often retain some antigen-binding function of the intact antigen-binding domain.

Examples for the format of a "domain which binds to" (or a "binding domain") or s include, but are not limited to, full-length antibodies, fragments of full-length antibodies (such as VH, VHH, VL), (s)dAb, Fv, light chain (VL-CL), Fd (VH-CH1), heavy chain, Fab, Fab', F(ab')2 or "r IgG" ("half antibody")), antibody variants or derivatives such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" (selected from formats such as (VH-VL-CH3)2, (scFv-CH3)2, ((scFv)2-CH3+CH3)), ((scFv)2-CH3) or (scFv-CH3-scFv)2, multibodies such as triabodies or tetrabodies, and single domain antibodies such as nanobodies or single variable domain antibodies comprising merely one variable region, which might be VHH, VH or VL. Further examples for the format of a "domain which binds to" (or a "binding domain") include (1) an antibody fragment or variant comprising VL, VH, CL and CH1 (such as Fab); (2) an antibody fragment or variant comprising two linked Fab fragments (such as a F(ab')2); (3) an antibody fragment or variant comprising VH and CH1 (such as Fd); (4) an antibody fragment or variant comprising VL and CL (such as the light chain); (5) an antibody fragment or variant comprising VL and VH (such as Fv); (5) a dAb fragment (Ward et al., (1989) Nature 341:544-546), which has a VH domain; (6) an antibody variant comprising at least three isolated CDRs of the heavy and/or the light chain; and (7) a single chain Fv (scFv). Examples for embodiments of antibody according to the invention are e.g. described in WO 00/006605, WO 2005/040220, WO 2008/119567, WO 2010/037838, WO 2013/026837, WO 2013/026833, US 2014/0308285, US 2014/0302037, W O2014/144722, WO 2014/151910, and WO 2015/048272.

In an scFv, the VH region and the and VL region are arranged in the order VH-VL or VL-VH (from N- to C-terminus). It is envisaged that the VH and the VL regions are connected via a linker, preferably a peptide linker. According to one embodiment, the VH-region is positioned N-terminally of the linker, and the VL-region is positioned C-terminally of the linker. It is furthermore possible that two scFv domains of an are connected via a linker, preferably a peptide linker. The scFv may e.g. comprise the domains in the order (from N-terminus to C-terminus) first domain-linker-second domain. The inverse order (second domain-linker-first domain) is also possible.

The linkers are preferably peptide linkers, more preferably short peptide linkers. In accordance with the present invention, a "peptide linker" comprises an amino acid sequence which connects the amino acid sequences of one domain with another (variable and/or binding) domain (e.g. a variable domain or a binding domain) of the antibody. An essential technical feature of such peptide linker is that it does not comprise any polymerization activity. Among the suitable peptide linkers are those described in U.S. Pat. Nos. 4,751,180 and 4,935,233 or WO 88/09344. In the present context, a "short" linker has between 2 and 50 amino acids, preferably between 3 and 35, between 4 and 30, between 5 and 25, between 6 and 20 or between 6 and 17 amino acids. The linker between two variable regions of one binding domain may have a different length (e.g. may be longer) than the linker between the two binding domains. For example, the linker between two variable regions of one binding domain may have a length between 7 and 15 amino acids, preferably between 9 and 13, and the linker between the two binding domains may have a length between 3 and 10 amino acids, preferably between 4 and 8. It is further envisaged that the peptide linkers are glycine/serine linkers. The majority of the amino acids in glycine/serine linkers are selected from glycine and serine.

According to one embodiment of the invention, an antibody of the invention which binds to MUC17 may be a "single chain antibody". Although the two domains of the Fv fragment, VL and VH, are coded for by separate genes, they can be joined, using recombinant methods, by an artificial linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are full-length antibodies or IgGs. A single-chain variable fragment (scFv) is hence a fusion protein of the variable region of the heavy chain (VH) and of the light chain (VL) of immunoglobulins, usually connected with a short linker peptide. The linker is usually rich in glycine for flexibility, as well as serine or also threonine for solubility, and can either connect the N-terminus of the VH with the C-terminus of the VL, or vice versa. This protein retains the specificity of the original immunoglobulin, despite removal of the constant regions and introduction of the linker.

Antibodies denominated "single domain antibodies" comprise one (monomeric) antibody variable region which is able to bind selectively to a specific antigen, independently of other variable regions. The first single domain antibodies were engineered from heavy chain antibodies found in camelids, and these are called VHH fragments. Cartilaginous fishes also have heavy chain antibodies (IgNAR) from which single domain antibodies called VNAR fragments can be obtained. An alternative approach is to split the dimeric variable regions from common immunoglobulins into monomers, hence obtaining VH or VL as a single domain Ab. Although most research into single domain antibodies is currently based on heavy chain variable regions, nanobodies derived from light chains were also shown to bind specifically to target epitopes. Examples of single domain antibodies are called sdAb, nanobodies or single variable domain antibodies. A (single domain mAb)2 is hence a monoclonal antibody composed of (at least) two single domain monoclonal antibody, which are individually selected from the group comprising VH, VL, VHH and VNAR. The linker is preferably in the form of a peptide linker. Similarly, an "scFv-single domain mAb" is a monoclonal antibody composed of at least one single domain antibody as described above and one scFv molecule as described above. Again, the linker is preferably in the form of a peptide linker.

According to one embodiment, the antibody or which binds to MUC17 is in the form of one or more polypeptides or in the form of proteins. In addition to proteinaceous parts, such polypeptides or proteins may include non-proteinaceous parts (e.g. chemical linkers or chemical cross-linking agents such as glutaraldehyde).

Peptides are short chains of amino acid monomers linked by covalent peptide (amide) bonds. Hence, peptides fall under the broad chemical classes of biological oligomers and polymers Amino acids that are part of a peptide or polypeptide chain are termed "residues" and can be consecutively numbered. All peptides except cyclic peptides have an N-terminal residue at one end and a C-term inal residue at the other end of the peptide. An oligopeptide consists of only a few amino acids (usually between two and twenty). A polypeptide is a longer, continuous, and unbranched peptide chain. Peptides are distinguished from proteins based on size, and as an arbitrary benchmark can be understood to contain approximately 50 or fewer amino acids. Proteins consist of one or more polypeptides, usually arranged in a biologically functional way. While aspects of the lab techniques applied to peptides versus polypeptides and proteins differ (e.g., the specifics of electrophoresis, chromatography, etc.), the size boundaries that distinguish peptides from polypeptides and proteins are not absolute. Therefore, in the context of the present invention, the terms "peptide", "polypeptide" and "protein" may be used interchangeably, and the term "polypeptide" is often preferred. The terms "peptide", "polypeptide" and "protein" also refer to naturally modified peptides/polypeptides/proteins wherein the modification is accomplished e.g. by post-translational modifications like glycosylation, acetylation, phosphorylation and the like. A "peptide", "polypeptide" or "protein" when referred to herein may also be chemically modified. Such modifications are well known in the art and described herein below.

The terms "(specifically or immunospecifically) binds to", "(specifically or immunospecifically) recognizes", or "(specifically or immunospecifically) reacts with" mean in accordance with this invention that an antibody, or a binding domain interacts or (immuno-)specifically interacts with a given epitope on the target molecule (antigen), here: MUC17. This interaction or association occurs more frequently, more rapidly, with greater duration, with greater affinity, or with some combination of the aforementioned, to an epitope on the specific target than to alternative substances (non-target molecules). Because of the sequence similarity between homologous proteins in different species, an antibody, or a binding domain that immunospecifically binds to its target (such as a human target) may, however, cross-react with homologous target molecules from different species (such as, from non-human primates such as cynomolgus monkeys). The term "specific/immunospecific binding" can hence include the binding of an antibody, or binding domain to epitopes or structurally related epitopes in more than one species.

In the context of the present invention, the term "epitope" refers to the part or region of the antigen that is recognized/immunospecifically recognized by the binding domain, antibody or derivative thereof. An "epitope" is antigenic, and thus the term epitope is sometimes also referred to as "antigenic structure" or "antigenic determinant". The part of the binding domain, antibody or that binds to the epitope is called a paratope. Specific binding is believed to be accomplished by specific motifs in the amino acid sequence of the binding domain, antibody or and the antigen. Thus, binding is achieved because of their primary, secondary and/or tertiary structure as well as the result of potential secondary modifications of said structures. The specific interaction of the paratope with its antigenic determinant may result in a simple binding of said site to the antigen. In some cases, the specific interaction may alternatively or additionally result in the initiation of a signal, e.g. due to the induction of a change of the conformation of the antigen, an oligomerization of the antigen, etc.

The epitopes of protein antigens are divided into two categories, conformational epitopes and linear epitopes, based on their structure and interaction with the paratope. A conformational epitope is composed of discontinuous sections of the antigen's amino acid sequence. These epitopes interact with the paratope based on the three-dimensional surface features and shape or tertiary structure (folding) of the antigen. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy. By contrast, linear epitopes interact with the paratope based on their primary structure. A linear epitope is formed by a continuous sequence of amino acids from the antigen and typically includes at least 3 or at least 4, and more usually, at least 5 or at least 6 or at least 7, for example, about 8 to about 10 amino acids in a unique sequence.

A method for MUC17 epitope mapping is described in the following: A pre-defined region (usually a contiguous amino acid stretch) within the extracellular domain of the human MUC17 protein is exchanged/replaced with a corresponding region of MUC17 of another species (such as mouse, but other species are also conceivable, so long as the antibody is not cross-reactive with the species). These human MUC17/mouse (or other species) MUC17 chimeras may be expressed on the surface of host cells (such as CHO cells). Binding of the antibody or can be tested via FACS analysis. When the binding of the antibody to the chimeric molecule is entirely abolished, or when a significant binding decrease is observed, it can be concluded that the region of human MUC17, which was removed from this chimeric molecule, is relevant for the immunospecific epitope-paratope recognition. Said decrease in binding is preferably at least 10%, 20%, 30%, 40%, or 50%; more preferably at least 60%, 70%, or 80%, and most preferably 90%, 95% or even 100% in comparison to the binding to human (wild-type) MUC17, whereby binding to human MUC17 is set to be 100%. Alternatively, the above described epitope mapping analysis can be modified by introducing one or more point mutations into the sequence of MUC17. These point mutations can e.g. reflect the differences between human MUC17 and mouse (or other species's) MUC17.

A further method to determine the contribution of a specific residue of a target antigen to the recognition by an antibody or binding domain is alanine scanning (see e.g. Morrison K L & Weiss G A. Curr Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired.

The interaction between the monoclonal antibody and the epitope of the target antigen implies that the variable regions exhibit appreciable or significant affinity for the epitope/the target antigen (here: MUC17) and, generally, does not exhibit significant affinity for proteins or antigens other than the target antigen—notwithstanding the above discussed cross-reactivity with homologous targets e.g. from other species. "Significant affinity" includes binding with an affinity (dissociation constant, KD) of about ≤10-6 M. Preferably, binding is considered specific when the binding affinity is about ≤10-7 M, ≤10-8 M, ≤10-9 M, or ≤10-10 M. It is hence envisaged that the monoclonal antibodies (or s) of the present invention have an affinity (KD) to MUC17 of about ≤10-7 M, ≤10-8 M, ≤10-9 M, or ≤10-10 M. These values are preferably measured in a surface plasmon resonance assay, such as a Biacore assay.

Whether an antibody (immuno-)specifically reacts with or binds to a target can be tested readily, e.g. by comparing the affinity of said antibody to its desired target protein or antigen with the affinity of said antibody to non-target proteins or antigens (here: proteins other than MUC17). Preferably, an antibody of the invention does not significantly bind to proteins or antigens other than MUC17—unless any further binding domain(s) directed against a further target is/are deliberately introduced into the antibody/of the invention. The term "does not significantly bind" means that a monoclonal antibody (or) of the present invention does not bind to a protein or antigen other than MUC17. The hence shows reactivity of ≤30%, preferably ≤20%, more preferably ≤10%, particularly preferably ≤9%, ≤8%, ≤7%, ≤6%, ≤5%, ≤4%, ≤3%, ≤2%, or ≤1% with proteins or antigens other than MUC17, whereby binding to MUC17 is set to be 100%. The "reactivity" can e.g. be expressed in an affinity value (see above). It is envisaged that the monoclonal antibody (or derivative, binding domain, etc.) of the invention does not bind to or does not significantly bind to, interact with, recognize, immunospecifically bind to or cross-react with human BAFF-R and/or human TACI.

The antibody of the present invention may be an "in vitro generated antibody" and/or a "recombinant antibody". In the context of the present invention, the term "in vitro generated" refers to an antibody according to the above definition where all or part of the variable region (e.g., at least one CDR) is generated in a non-immune cell selection, e.g., in an in vitro phage display, on a protein chip or in any other method in which candidate amino acid sequences can be tested for their ability to bind to an antigen. This term thus preferably excludes sequences generated solely by genomic rearrangement in an immune cell in an animal. It is envisaged that the antibody is produced by or obtainable by phage display or library screening methods or by grafting CDR sequences from a pre-existing antibody into a scaffold. A "recombinant antibody" is an antibody generated or produced using (inter alia) recombinant DNA technology or genetic engineering.

A preferred type of an amino acid substitutional variation of the antibody of the invention involves substituting one or more residues within the hypervariable region of a parent antibody structure. Generally, the resulting variant(s) selected for further development will have improved biological properties relative to the parent antibody structure from which they are generated. A convenient way for generating such substitutional variants involves affinity maturation using phage display. Briefly, several sites of the hypervariable region (e. g. 6-7 sites) are mutated to generate all possible amino acid substitutions at each site. The variants thus generated are displayed in a monovalent fashion from filamentous phage particles as fusions to the gene III product of M13 packaged within each particle. The phage-displayed variants are then screened for their biological activity (e.g. binding affinity) as disclosed herein. To identify candidate hypervariable region sites contributing significantly to antigen binding (candidates for modification), alanine scanning mutagenesis can also be performed. Alternatively, or additionally, it may be beneficial to analyze a crystal structure of the complex between the antigen and the antibody or the binding domain to identify contact points between the antibody binding domain and its specific antigen. Such contact residues and neighboring residues are candidates for substitution according to the techniques elaborated herein. Once such variants are generated, the panel of variants is subjected to screening as described herein and antibodies, their antigen-binding fragments, s or binding domains with superior properties in one or more relevant assays may be selected for further development.

According to one embodiment, the antibody, derived from a mouse. The term "antibody" includes antibodies and binding domains, respectively, having antibody-derived regions such as variable and constant regions or domains which correspond substantially to germline immunoglobulin sequences known in the art. The binding domains of the invention may include amino acid residues not encoded by germline immunoglobulin sequences (e.g., mutations introduced by random or site-specific mutagenesis in vitro or by somatic mutation in vivo), for example in the CDRs, and particularly in CDR3. The antibody binding domains can have at least one, two, three, four, five, or more positions replaced with an amino acid residue that is not encoded by the germline immunoglobulin sequence. The definition of antibodies, and binding domains as used herein also contemplates antibodies and binding domains which include only non-artificially and/or genetically altered sequences of antibodies.

It is envisaged that the antibodies of the invention are "isolated" or "substantially pure" antibodies. "Isolated" or "substantially pure", when used to describe the antibodies described herein, means an antibody that has been identified, separated and/or recovered from a component of its production environment. Preferably, the antibody is free or substantially free of association with all other components from its production environment. Contaminant components of its production environment, such as that resulting from recombinant transfected cells, are materials that could interfere e.g. with diagnostic uses for the antibody, and may include enzymes, hormones, and other proteinaceous or non-proteinaceous compounds. It is understood that the isolated or substantially pure antibody may constitute from 5% to 99.9% by weight of the total protein/polypeptide content in a given sample, depending on the circumstances. The desired antibody may be produced at a significantly higher concentration using an inducible promoter or high expression promoter. The definition includes the production of an antibody in a wide variety of organisms and/or host cells that are known in the art. In certain embodiments, the antibody will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver staining. Usually, however, an isolated antibody will be prepared by at least one purification step.

According to one embodiment of the present invention, the monoclonal antibody or binding domain comprises a VH region comprising a VH-CDR1 as depicted in SEQ ID NO: 2, a VH-CDR2 as depicted in SEQ ID NO: 3, and a VH-CDR3 as depicted in SEQ ID NO: 4, and a VL region comprising a VL-CDR1 as depicted in SEQ ID NO: 6, a VL-CDR2 as depicted in SEQ ID NO: 7, and a VL-CDR3 as depicted in SEQ ID NO: 8.

It is furthermore envisaged that the antibody of the present invention binds to the same MUC17 epitope as the antibody of a), of b), or of c) above, or competes for binding to MUC17 with the antibody of a), of b), or of c) above.

Whether or not an antibody or binding domain binds to the same epitope of MUC17 (or of the extracellular domain of MUC17) as another given antibody or binding domain can be measured by different analyses, e.g. by epitope mapping with chimeric or mutated MUC17 molecules, as described e.g. in WO 2013/072406. Other methods of determining epitopes are described herein, such as alanine scanning (see e.g. Morrison K L & Weiss G A. Curr Opin Chem Biol. 2001 June; 5(3):302-7), where each residue within the target amino acid sequence to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. This method where systematic mutations of amino acids are introduced into the sequence of the target protein, and binding of an antibody to each mutated protein is tested to identify the amino acids that comprise the epitope, is also called "site-directed mutagenesis". Other methods available for mapping antibody epitopes on target antigens are high-throughput shotgun mutagenesis epitope mapping, cross-linking-coupled mass spectrometry, X-ray co-crystallography, cryogenic electron microscopy, and hydrogen-deuterium exchange.

Whether or not an antibody competes for binding to an antigen (such as MUC17) with another given antibody can be measured in a competition assay such as a competitive ELISA. Avidin-coupled microparticles (beads) can also be used Similar to an avidin-coated ELISA plate, when reacted with a biotinylated protein, each of these beads can be used as a substrate on which an assay can be performed. Antigen is coated onto a bead and then precoated with the first antibody. The second antibody is added, and any additional binding is determined. Read-out occurs via flow cytometry. A cell-based competition assay may be used, using either cells that naturally express MUC17 or cells that were stably or transiently transformed with MUC17. The term "competes for binding", in the present context, means that competition occurs between the two tested antibodies of at least 20%, at least 30%, at least 40%, at least 50%, at least 60%, at least 70%, at least 80% or at least 90%, as determined by any one of the assays disclosed above.

According to one embodiment of the present invention, the antibody comprises:

a) a VH region comprised in SEQ ID NO: 5;

b) a VL region as depicted in any one of SEQ ID NO: 9;

or a monoclonal antibody of the present invention c) binds to the same MUC17 epitope as the antibody of c) or competes for binding to MUC17 with the antibody of c);

d) binds to the same MUC17 epitope as the antibody of d) or competes for binding to MUC17 with the antibody of d); or e) binds to the same MUC17 epitope as the antibody of e) or competes for binding to MUC17 with the antibody of e).

It is envisaged that the monoclonal antibody of the present invention (or the "first monoclonal antibody") and/or the second monoclonal antibody as defined herein bind(s) to MUC17 in a sample. According to one embodiment, this sample may be a biological sample. According to one embodiment, the sample is a human sample, e.g. a human biological sample. The biological sample may be a (human) serum sample, plasma sample, blood sample, bone marrow sample or tissue sample. The sample may also be supernatant obtained from a cell culture of (human) bone marrow mononuclear cells or of (human) peripheral blood mononuclear cells. The sample may be obtained from a subject, e.g. a human subject, suspected of having, or having (being diagnosed with) a disease associated with MUC17 or increased MUC17, or a subject having received treatment for a disease associated with MUC17 or increased MUC17.

"Blood" is a body fluid in humans and other animals that delivers necessary substances such as nutrients and oxygen to the cells and transports metabolic waste products away from those same cells. In vertebrates, blood is composed of blood cells suspended in blood plasma. Blood plasma or "plasma" is the liquid component of the blood in which several types of blood cells are suspended. It is mostly water and contains dissolved proteins (such as serum albumins, globulins, fibrinogen, and others), glucose, clotting factors, electrolytes, hormones, carbon dioxide and oxygen. Blood serum or "serum" is plasma without clotting factors. Serum hence includes all plasma proteins not used in coagulation. "Bone marrow" is a semi-solid tissue which may be found within the spongy or cancellous portions of bones. A "tissue" is a cellular organizational level between cells and a complete organ. A tissue is an ensemble of similar cells and their extracellular matrix from the same origin that together carry out a specific function. Organs are then formed by the functional grouping together of multiple tissues.

Covalent modifications of the antibody of the invention are also included within the scope of this invention, and are generally, but not always, done post-translationally. For example, several types of covalent modifications of the antibody are introduced into the molecule by reacting specific amino acid residues of the antibody with an organic derivatizing agent that can react with selected side chains or with the N- or C-terminal residues. Derivatization with bifunctional agents is useful for crosslinking the antibody of the present invention to a water-insoluble support matrix or surface for use in a variety of methods, particularly detection methods. Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention. Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

According to the present invention, the monoclonal antibody is coupled to a detectable label. In some embodiments, the covalent modification of the monoclonal antibody of the invention comprises the addition of one or more labels, such as detection labels. The label or labelling group may be coupled to the antibody via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^{3}H$, $^{14}C$, $^{15}N$, $^{35}S$, $^{89}Zr$, $^{90}Y$, $^{99}Tc$, $^{111}In$, $^{125}I$, $^{131}I$)

b) magnetic labels (e.g., magnetic particles)

c) redox active moieties d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores e) enzymatic groups (e.g. horseradish peroxidase, β-galactosidase, luciferase, alkaline phosphatase)

f) biotinylated groups g) predetermined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus*, or *Aequorea* species of GFP (Chalfie et al., 1994, Science 263:802-805), EGFP (Clontech Laboratories, Inc., Genbank® Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, Biotechniques 24:462-471; Heim et al., 1996, Curr. Biol. 6:178-182), enhanced yellow fluorescent protein (EYFP, Clontech Laboratories, Inc.), luciferase (Ichiki et al., 1993, J. Immunol. 150:5408-5417), β galactosidase (Nolan et al., 1988, Proc.

Natl. Acad. Sci. U.S.A. 85:2603-2607) and *Renilla* (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

The antibody of the invention may also comprise additional domains, which are e.g. helpful in the isolation of the molecule. Domains helpful for the isolation of an antibody may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibodies characterized by the identified CDRs may comprise a His-tag domain, which is generally known as a repeat of consecutive His residues in the amino acid sequence of a molecule, e.g. of five His residues, or of six His residues (hexa-histidine). The His-tag may be located e.g. at the N- or C-terminus of an antibody. In one embodiment, a hexa-histidine tag is linked via peptide bond to the C-terminus of an antibody according to the invention.

The invention further provides a polynucleotide/nucleic acid molecule encoding an antibody of the invention. Nucleic acid molecules are biopolymers composed of nucleotides. A polynucleotide is a biopolymer composed of 13 or more nucleotide monomers covalently bonded in a chain. DNA (such as cDNA) and RNA (such as mRNA) are examples of polynucleotides/nucleic acid molecules with distinct biological function. Nucleotides are organic molecules that serve as the monomers or subunits of nucleic acid molecules like DNA or RNA. The nucleic acid molecule or polynucleotide of the present invention can be double stranded or single stranded, linear or circular. It is envisaged that the nucleic acid molecule or polynucleotide is comprised in a vector. It is furthermore envisaged that such vector is comprised in a host cell. Said host cell is, e.g. after transformation or transfection with the vector or the polynucleotide/nucleic acid molecule of the invention, capable of expressing the antibody. For this purpose, the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because most genes are encoded with exactly the same code, this particular code is often referred to as the canonical or standard genetic code.

Degeneracy of codons is the redundancy of the genetic code, exhibited as the multiplicity of three-base pair codon combinations that specify an amino acid. Degeneracy results because there are more codons than encodable amino acids. The codons encoding one amino acid may differ in any of their three positions; however, often this difference is in the second or third position. For instance, codons GAA and GAG both specify glutamic acid and exhibit redundancy; but, neither specifies any other amino acid and thus demonstrate no ambiguity. The genetic codes of different organisms can be biased towards using one of the several codons that encode the same amino acid over the others—that is, a greater frequency of one will be found than expected by chance. For example, leucine is specified by six distinct codons, some of which are rarely used. Codon usage tables detailing genomic codon usage frequencies for most organisms are available. Recombinant gene technologies commonly take advantage of this effect by implementing a technique termed codon optimization, in which those codons are used to design a polynucleotide which are preferred by the respective host cell (such as a cell of human hamster origin, an *Escherichia coli* cell, or a *Saccharomyces cerevisiae* cell), e.g. to increase protein expression. It is hence envisaged that the polynucleotides/nucleic acid molecules of the present disclosure are codon optimized. Nevertheless, the polynucleotide/nucleic acid molecule encoding an antibody of the invention may be designed using any codon that encodes the desired amino acid.

According to one embodiment, the polynucleotide/nucleic acid molecule of the present invention encoding the antibody of the invention is in the form of one single molecule or in the form of two or more separate molecules. If the of the present invention is a single chain, the polynucleotide/nucleic acid molecule encoding such construct will most likely also be in the form of one single molecule. However, it is also envisaged that different components of the antibody (such as the heavy chain and the light chain) are located on separate polypeptide chains, in which case the polynucleotide/nucleic acid molecule is most likely in the form of two (or more) separate molecules.

The same applies for the vector comprising a polynucleotide/nucleic acid molecule of the present invention. If the antibody of the present invention is a single chain antibody, one vector may comprise the polynucleotide which encodes the antibody in one single location (as one single open reading frame, ORF). One vector may also comprise two or more polynucleotides/nucleic acid molecules at separate locations (with individual ORFs), each one of them encoding a different component of the antibody, such as the heavy chain and the light chain of the invention. It is envisaged that the vector comprising the polynucleotide/nucleic acid molecule of the present invention is in the form of one single vector or two or more separate vectors. In one embodiment, and for the purpose of expressing the antibody in a host cell, the host cell of the invention should comprise the polynucleotide/nucleic acid molecule encoding the antibody or the vector comprising such polynucleotide/nucleic acid molecule in their entirety, meaning that all components of the antibody—whether encoded as one single molecule or in separate molecules/locations—will assemble after translation and form together the biologically active antibody of the invention.

The invention also provides a vector comprising a polynucleotide/nucleic acid molecule of the invention. A vector is a nucleic acid molecule used as a vehicle to transfer (foreign) genetic material into a cell, usually for replication and/or expression. The term "vector" encompasses—but is not restricted to—plasmids, viruses, cosmids, and artificial chromosomes. Some vectors are designed specifically for cloning (cloning vectors), others for protein expression (expression vectors). So-called transcription vectors are mainly used to amplify their insert. The manipulation of DNA is normally conducted on *E. coli* vectors, which contain elements necessary for their maintenance in *E. coli*. However, vectors may also have elements that allow them to be maintained in another organism such as yeast, plant or mammalian cells, and these vectors are called shuttle vectors. Insertion of a vector into the target or host cell is usually called transformation for bacterial cells and transfection for eukaryotic cells, while insertion of a viral vector is often called transduction.

In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. While the genetic code determines the polypeptide sequence for a given coding region, other genomic regions can influence when and where these polypeptides are produced. Modern vectors may therefore encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a host organism. The control sequences that are suitable for prokaryotes, for example, include a promoter, optionally an operator sequence, and a ribosome binding site. Eukaryotic cells are known to utilize promoters, polyadenylation signals, a Kozak sequence and enhancers.

A nucleic acid is "operably linked" when it is placed into a functional relationship with another nucleic acid sequence. For example, DNA for a pre-sequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the nucleotide sequences being linked are contiguous, and, in the case of a secretory leader, contiguous and in reading phase. However, enhancers do not have to be contiguous Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using biological particles (such as viral transfection, also called viral transduction), chemical-based methods (such as using calcium phosphate, lipofection, Fugene, cationic polymers, nanoparticles) or physical treatment (such as electroporation, microinjection, gene gun, cell squeezing, magnetofection, hydrostatic pressure, impalefection, sonication, optical transfection, heat shock).

The term "transformation" is used to describe non-viral transfer of nucleic acid molecules or polynucleotides (including vectors) into bacteria, and into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be carried out by artificial means. For transformation to happen, cells or bacteria must be in a state of competence, which might occur as a time-limited response to environmental conditions such as starvation and cell density and can also be artificially induced.

Moreover, the invention provides a host cell transformed or transfected with the polynucleotide/nucleic acid molecule of the invention or with the vector of the invention. As used herein, the terms "host cell" or "recipient cell" are intended to include any individual cell or cell culture that can be or has been recipient of vectors, exogenous nucleic acid molecules and/or polynucleotides encoding the antibody of the present invention; and/or recipients of the antibody itself. The introduction of the respective material into the cell is carried out by way of transformation, transfection and the like (vide supra). The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell but is still included within the scope of the term as used herein. Suitable host cells include prokaryotic or eukaryotic cells and include—but are not limited to—bacteria (such as *E. coli*), yeast cells, fungi cells, plant cells, and animal cells such as insect cells and mammalian cells, e.g., hamster, murine, rat, macaque or human cells.

In addition to prokaryotes, eukaryotic microbes such as filamentous fungi or yeast are suitable cloning or expression hosts for the antibody of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), K. wickeramii (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma* reesia (EP 244 234); *Neurospora crassa; Schwanniomyces* such as *Schwanniomyces occidentalis*; and filamentous fungi such as *Neurospora, Penicillium, Tolypocladium*, and *Aspergillus* hosts such as *A. nidulans* and *A. niger.*

Suitable host cells for the expression of a glycosylated antibody are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (cell culture)

has become a routine procedure. Examples of useful mammalian host cell lines are monkey kidney CV1 line transformed by SV40 (such as COS-7, ATCC CRL 1651); human embryonic kidney line (such as 293 or 293 cells subcloned for growth in suspension culture, Graham et al., J. Gen Virol. 36: 59 (1977)); baby hamster kidney cells (such as BHK, ATCC CCL 10); Chinese hamster ovary cells/-DHFR (such as CHO, Urlaub et al., Proc. Natl. Acad. Sci. USA 77: 4216 (1980)); mouse sertoli cells (such as TM4, Mather, Biol. Reprod. 23: 243-251 (1980)); monkey kidney cells (such as CVI ATCC CCL 70); African green monkey kidney cells (such as VERO-76, ATCC CRL1587); human cervical carcinoma cells (such as HELA, ATCC CCL 2); canine kidney cells (such as MDCK, ATCC CCL 34); buffalo rat liver cells (such as BRL 3A, ATCC CRL 1442); human lung cells (such as W138, ATCC CCL 75); human liver cells (such as Hep G2, 1413 8065); mouse mammary tumor (such as MMT 060562, ATCC CCL-51); TRI cells (Mather et al., Annals N. Y Acad. Sci. (1982) 383: 44-68); MRC 5 cells; FS4 cells; and a human hepatoma line (such as Hep G2).

In a further embodiment, the invention provides a process for producing an antibody of the invention, said process comprising culturing a host cell of the invention under conditions allowing the expression of the antibody of the invention and recovering the produced antibody from the culture.

As used herein, the term "culturing" refers to the in vitro maintenance, differentiation, growth, proliferation and/or propagation of cells under suitable conditions in a medium. Cells are grown and maintained in a cell growth medium at an appropriate temperature and gas mixture. Culture conditions vary widely for each cell type. Typical growth conditions are a temperature of about 37° C., a CO2 concentration of about 5% and a humidity of about 95%. Recipes for growth media can vary e.g. in pH, concentration of the carbon source (such as glucose), nature and concentration of growth factors, and the presence of other nutrients (such as amino acids or vitamins). The growth factors used to supplement media are often derived from the serum of animal blood, such as fetal bovine serum (FBS), bovine calf serum (FCS), equine serum, and porcine serum. Cells can be grown either in suspension or as adherent cultures. There are also cell lines that have been modified to be able to survive in suspension cultures, so they can be grown to a higher density than adherent conditions would allow.

The term "expression" includes any step involved in the production of an antibody of the invention including, but not limited to, transcription, post-transcriptional modification, translation, folding, post-translational modification, targeting to specific subcellular or extracellular locations, and secretion. The term "recovering" refers to a series of processes intended to isolate the antibody from the cell culture. The "recovering" or "purification" process may separate the protein and non-protein parts of the cell culture, and finally separate the desired antibody from all other polypeptides and proteins. Separation steps usually exploit differences in protein size, physico-chemical properties, binding affinity and biological activity. Preparative purifications aim to produce a relatively large quantity of purified proteins for subsequent use, while analytical purification produces a relatively small amount of a protein for a variety of research or analytical purposes.

When using recombinant techniques, the antibody can be produced intracellularly, in the periplasmic space, or directly secreted into the medium. If the antibody is produced intracellularly, as a first step, the particulate debris, either host cells or lysed fragments, are removed, for example, by centrifugation or ultrafiltration. The antibody of the invention may e.g. be produced in bacteria such as *E. coli*. After expression, the construct is isolated from the bacterial cell paste in a soluble fraction and can be purified e.g. via affinity chromatography and/or size exclusion. Final purification can be carried out in a manner like the process for purifying an antibody expressed in mammalian cells and secreted into the medium. Carter et al. (Biotechnology (NY) 1992 February; 10(2):163-7) describe a procedure for isolating antibodies which are secreted to the periplasmic space of *E. coli.*

Where the antibody is secreted into the medium, supernatants from such expression systems are generally first concentrated using a commercially available protein concentration filter, for example, an ultrafiltration unit.

The antibody of the invention prepared from the host cells can be recovered or purified using, for example, hydroxylapatite chromatography, gel electrophoresis, dialysis, and affinity chromatography. Other techniques for protein purification such as fractionation on an ion-exchange column, mixed mode ion exchange, HIC, ethanol precipitation, size exclusion chromatography, reverse phase HPLC, chromatography on silica, chromatography on heparin sepharose, chromatography on an anion or cation exchange resin (such as a polyaspartic acid column), immunoaffinity (such as Protein A/G/L) chromatography, chromato-focusing, SDS-PAGE, ultracentrifugation, and ammonium sulfate precipitation are also available depending on the antibody to be recovered. A protease inhibitor may be included in any of the foregoing steps to inhibit proteolysis, and antibiotics may be included to prevent the growth of contaminants.

Moreover, the invention provides a composition or formulation comprising the antibody of the invention or comprising the antibody produced according to the process of the invention. The composition is preferably a diagnostic composition. As used herein, the term "diagnostic composition" relates to a composition which is suitable for use in a diagnostic kit or in a detection system. One possible diagnostic composition of this invention comprises one or a plurality of the antibodies of the invention, preferably in an amount that is useful for the detection of MUC17 in a sample. The diagnostic composition may further comprise suitable formulations of one or more carriers, stabilizers, excipients, diluents, solubilizers, surfactants, emulsifiers, preservatives and/or adjuvants. Diagnostic compositions of the invention include, but are not limited to, liquid, frozen, and lyophilized compositions.

The compositions may comprise a carrier such as a diagnostically acceptable carrier. In general, as used herein, "diagnostically acceptable carrier" means all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with diagnostic use. The use of such media and agents in diagnostic compositions is well known in the art, and the compositions comprising such carriers can be formulated by well-known conventional methods.

Certain embodiments provide diagnostic compositions comprising the antibody of the invention and further one or more excipients such as those illustratively described in this section and elsewhere herein. Excipients can be used in the invention for a wide variety of purposes, such as adjusting physical, chemical, or biological properties of formulations, such as adjustment of viscosity, and or processes of the invention to improve effectiveness and/or to stabilize such formulations and processes against degradation and spoilage e.g. due to stresses that occur during manufacturing, shipping, storage, pre-use preparation, administration, and thereafter. Excipients should in general be used in their lowest effective concentrations.

In certain embodiments, the diagnostic composition may contain formulation materials for modifying, maintaining or preserving certain characteristics of the composition such as the pH, osmolarity, viscosity, clarity, color, isotonicity, odor, sterility, stability, rate of dissolution or release, adsorption or penetration (see, Remington's Pharmaceutical Sciences, 18" Edition, 1990, Mack Publishing Company). In such embodiments, suitable formulation materials may include, but are not limited to:

- amino acids
- antimicrobials such as antibacterial and antifungal agents
- antioxidants
- buffers, buffer systems and buffering agents which are used to maintain the composition at physiological pH or at a slightly lower pH, typically within a pH range of from about 5 to about 8 or 9
- non-aqueous solvents, vegetable oils, and injectable organic esters
- aqueous carriers including water, alcoholic/aqueous solutions, emulsions or suspensions, including saline and buffered media
- biodegradable polymers such as polyesters
- bulking agents
- chelating agents
- isotonic and absorption delaying agents
- complexing agents
- fillers
- carbohydrates
- (low molecular weight) proteins, polypeptides or proteinaceous carriers, preferably of human origin
- coloring and flavoring agents
- sulfur containing reducing agents
- diluting agents
- emulsifying agents
- hydrophilic polymers
- salt-forming counter-ions
- preservatives
- metal complexes
- solvents and co-solvents
- sugars and sugar alcohols
- suspending agents
- surfactants or wetting agents
- stability enhancing agents
- tonicity enhancing agents
- parenteral delivery vehicles
- intravenous delivery vehicles It is common knowledge that the different constituents of the diagnostic composition can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

According to a further aspect, the present invention provides a detection system comprising: a) a first monoclonal antibody (or derivative thereof) which binds to MUC17, and b) optionally a second monoclonal antibody (or derivative thereof) which binds to MUC17, wherein the binding of the first monoclonal antibody (or derivative thereof) to MUC17 occurs in the presence of the second monoclonal antibody (or derivative thereof) binding to MUC17.

The present invention also provides a detection system comprising: a) a first monoclonal antibody (or derivative thereof) which binds to MUC17, and b) optionally a second monoclonal antibody (or derivative thereof) which binds to MUC17, wherein the binding of the second monoclonal antibody (or derivative thereof) to MUC17 occurs in the presence of the first monoclonal antibody (or derivative thereof) binding to MUC17.

The present invention also provides a detection system comprising: a) a first monoclonal antibody (or derivative thereof) which binds to MUC17, and b) optionally a second monoclonal antibody (or derivative thereof) which binds to MUC17, wherein the binding of the first monoclonal antibody (or derivative thereof) to MUC17 occurs in the presence of the second monoclonal antibody (or derivative thereof) binding to MUC17, and wherein the binding of the second monoclonal antibody (or derivative thereof) to MUC17 occurs in the presence of the first monoclonal antibody (or derivative thereof) binding to MUC17.

A "detection system" is a kit or tool (or a diagnostic kit/tool) comprising reagents for carrying out an analytical assay. In the context of the present invention, the assay detects and/or quantifies the presence of MUC17 in a sample, usually a tissue sample. The detection system comprises antibodies which bind to MUC17. Usually, the detection system involves the use of a solid support (such as a microtiter plate or a membrane) which serves as a surface to immobilize either the antigen to be detected (e.g. in the case of a "direct ELISA") or the (monoclonal) antibody binding to MUC17 (the "capture antibody"), or a "secondary antibody" (e.g. an anti-Fc antibody) which binds to the antibody binding to MUC17 (the capture antibody). In general, the immobilization occurs either non-specifically (via adsorption to the surface) or specifically (via capture by an antibody, e.g. a secondary antibody). A detection system may furthermore comprise a (monoclonal) detection antibody binding to MUC17 (optionally coupled with an enzyme, a detectable label or a reporter group), and optionally a secondary antibody (e.g. an anti-Fc antibody) which binds to the detection antibody and which is coupled with an enzyme, a detectable label or a reporter group.

A very well know detection system is the ELISA assay, which can be used for the purposes of the present invention. A "sandwich" ELISA is used to detect sample antigen or to quantify an unknown amount of the antigen. The steps may include: A surface is provided to which a known quantity of so-called "capture antibody" is bound. This binding may occur directly via adsorption of the capture antibody to the surface or via a secondary antibody (e.g. an anti-Fc antibody) which is adsorbed to the surface and which binds to the capture antibody. Any nonspecific binding sites on the surface are blocked. The antigen-containing sample is applied to the surface, and antigen is captured (bound) by the antibody. The plate is washed to remove unbound antigen. A "detection antibody" is added and binds to the antigen. This detection antibody may be coupled (e.g. covalently linked) with an enzyme, a detectable label or a reporter group. If this is not the case, a secondary antibody is applied that is coupled with an enzyme, a detectable label or a reporter group and that binds to the detection antibody, e.g. to its Fc region. The plate is washed to remove any unbound antibodies. A chemical substrate is added that is converted (e.g. by the enzyme) to a detectable form, such as an optical signal (e.g. color or fluorescent) or an electrochemical signal. The absorbance or fluorescence or electrochemical signal (e.g., current) of the plate wells or surface is measured to determine the presence and/or quantity of the antigen. Commonly used enzymatic markers include:

OPD (o-phenylenediamine dihydrochloride) turns amber to detect horseradish peroxidase (HRP) which is often used as conjugated protein TMB (3,3',5,5'-tetramethylbenzidine) turns blue when detecting HRP and turns yellow sulfuric or phosphoric acid ABTS (2,2'-Azinobis [3-ethylbenzothiazoline-6-sulfonic acid]-diammonium salt) turns green when detecting HRP PNPP (p-Nitrophenyl Phosphate, Disodium Salt) turns yellow when detecting alkaline phosphatase Traditional ELISA typically involves chromogenic reporters and substrates that produce observable color change to indicate the presence of antigen. Newer ELISA-like techniques use fluorogenic, electrochemiluminescent and quantitative PCR reporters to create quantifiable signals. These new reporters can have various advantages, including higher sensitivities and multiplexing. In technical terms, these assays are not strictly "ELISAs", as they are not "enzyme-linked", but are instead linked to some non-enzymatic reporter. However, given that the general principles in these assays are largely similar, they are often grouped in the same category as ELISAs.

The detection system may be used in a qualitative or quantitative format. Qualitative results provide a simple positive or negative result (yes or no) for a sample. The cutoff between positive and negative may be statistical. Two or three times the standard deviation (error inherent in a test) is often used to distinguish positive from negative samples. In a quantitative format, the optical density (OD) of the sample or the electrochemical signal is compared to a standard curve, which is typically a serial dilution of a known-concentration solution of the target molecule.

The present invention also provides that the first monoclonal antibody (or binding domain) of the detection system:

a) comprises a VH region comprising a VH-CDR1 as depicted in SEQ ID NO: 2, a VH-CDR2 as depicted in SEQ ID NO: 3, and a VH-CDR3 as depicted in SEQ ID NO: 4, and a VL region comprising a VL-CDR1 as depicted in SEQ ID NO: 6, a VL-CDR2 as depicted in SEQ ID NO: 7, and a VL-CDR3 as depicted in SEQ ID NO: 8;

b) binds to the same MUC17 epitope as the antibody of a), or competes for binding to MUC17 with the antibody of a); or c) binds to the same MUC17 epitope as the antibody of b) or competes for binding to MUC17 with the antibody of b).

The present invention also provides that the monoclonal antibody of the detection system:

a) comprises a VH region comprised in SEQ ID NO: 5;

b) comprises a VL region comprised in SEQ ID NO: 7;

c) comprises a VH region comprised in SEQ ID NO: 5 and a VL region comprised in SEQ ID NO: 7;

d) binds to the same MUC17 epitope as the antibody of c), or competes for binding to MUC17 with the antibody of c); or e) binds to the same MUC17 epitope as the antibody of d) or competes for binding to MUC17 with the antibody of d).

It is envisaged for the detection system that a first monoclonal antibody is used as capture antibody, and a second monoclonal antibody is used as detection antibody.

In a further aspect, the present invention also provides the use of an antibody of the present invention or the use of the detection system of the present invention for:

detecting MUC17 in a sample;

quantifying MUC17 in a sample;

diagnosing a disease associated with MUC17 or increased MUC17;

stratifying patients diagnosed with a disease associated with MUC17 or increased MUC17;

monitoring the progression of a disease associated with MUC17 or increased MUC17; or monitoring the response to treatment of a disease associated with MUC17 or increased MUC17.

In one embodiment, the sample is a biological sample, such as a human biological sample. A sample (biological sample/human biological sample) may be a serum sample, plasma sample, blood sample, bone marrow sample or tissue sample. The sample may also be supernatant obtained from a cell culture of bone marrow mononuclear cells or of peripheral blood mononuclear cells. The sample may be obtained from a subject, e.g. a human subject, suspected of having or having (being diagnosed with) a disease associated with MUC17 or increased MUC17, or a subject having received treatment for a disease associated with MUC17 or increased MUC17. In particular embodiments, the sample is tissue sample derived from a tissue that is suspected to be affected by neoplastic growth, i.e. cancer.

A disease is a particular abnormal condition that negatively affects the structure or function of part or all of an organism, such as a human, and that is not due to any external injury. Diseases are often construed as "medical conditions" or "disorders" that are associated with specific signs and symptoms. The disease according to the present invention is associated with MUC17 or increased MUC17. The term "increased" is used comparison with a healthy subject, i.e. a subject that does not have such disease. According to one embodiment, the disease associated with MUC17 or increased MUC17 is a "MUC17 positive neoplasm".

A "neoplasm" is an abnormal growth of tissue, usually but not always forming a mass. When also forming a mass, it is commonly referred to as a "tumor". In brain tumors, the uncontrolled division of cells means that the mass of a neoplasm increases in size, and in a confined space such as the intracranial cavity this quickly becomes problematic because the mass invades the space of the brain pushing it aside, leading to compression of the brain tissue and increased intracranial pressure and destruction of parenchyma. According to the invention, the "neoplasm" or "tumor" also refers to a condition that would benefit from treatment with a therapy directed to MUC17, in particular, MUC17 expressed on the cell surface (such as MUC17-specific antibodies—including naked antibodies, antibody-drug conjugates (ADCs). This condition includes chronic and acute disorders or diseases including those pathological conditions that predispose a mammal to the condition (neoplasm or tumor) in question.

Neoplasms or tumors can be benign, potentially malignant (pre-cancerous), or malignant (cancerous). Malignant neoplasms/tumors are commonly called cancer. They usually invade and destroy the surrounding tissue and may form metastases, i.e., they spread to other parts, tissues or organs of the body. A "primary tumor" is a tumor growing at the anatomical site where tumor progression began and proceeded to yield a cancerous mass. For example, a gastrointestinal tumor occurs when abnormal cells form within the gastrointestinal tract. Most cancers develop at their primary site but then go on to form metastases or spread to other parts (e.g. tissues and organs) of the body. These further tumors are secondary tumors. Most cancers continue to be called after their primary site, even after they have spread to other parts of the body.

For the purposes of the present invention, the terms "neoplasm", "tumor" and "cancer" may be used interchangeably, and they comprise both primary tumors/cancers and secondary tumors/cancers (or "metastases, and also MRD. The term "minimal residual disease" (MRD) refers to the evidence for the presence of small numbers of residual cancer cells that remain in the patient after cancer treatment, e.g. when the patient is in remission (the patient has no symptoms or signs of disease). A very small number of remaining cancer cells usually cannot be detected by routine means because the standard tests used to assess or detect cancer are not sensitive enough to detect MRD. Nowadays, very sensitive molecular biology tests for MRD are available, such as flow cytometry, PCR and next-generation sequencing. These tests can measure minimal levels of cancer cells in tissue samples, sometimes as low as one cancer cell in a million normal cells. In the context of the present invention, the terms "prevention", "treatment" or "amelioration" of a neoplasm are envisaged to also encompass "prevention, treatment or amelioration of MRD", whether the MRD was detected or not.

The "disease associated with MUC17 or increased MUC17", the "MUC17 positive neoplasm" or the "(MUC17 positive) neoplasm" may be selected from the group including, but not limited to, . . . .

"Diagnosis" or "medical diagnosis" is the process of determining which disorder or condition explains a subject's symptoms and signs. Usually, one or more diagnostic procedures, such as diagnostic or medical tests, are done during the process. In medicine, the term "monitoring" refers to the observation of a disease, condition or one or several medical parameters over time. It can be performed by continuously measuring certain parameters by using a medical monitor and/or by repeatedly performing medical tests. A diagnostic or medical test is a medical procedure performed to detect, diagnose or monitor diseases, disease processes, susceptibility, and/or determine a course of treatment. It is related to clinical chemistry and molecular diagnostics, and the procedures are typically performed in a medical laboratory.

Medical therapies or treatments are efforts to cure or improve a disease. In the medical field, common treatments include medications. A medication (also referred to as medicine, pharmaceutical drug or drug) is used to diagnose, cure, treat or prevent a disease. The term "treatment" hence refers to both therapeutic treatment and prophylactic or preventative measures.

In a further aspect, the present invention also provides a method for detecting and/or quantifying MUC17 in a sample, comprising the steps of:

(a) using an antibody of the present invention, or using a detection system of the present invention for determining the content of MUC17 in a sample; and (b) comparing the content of MUC17 determined in step (a) to (i) a pre-defined value for the MUC17 content, (ii) the content of MUC17 determined in a control sample, or (c) the content of MUC17 determined in a sample obtained from the same source or subject at a previous time point.

For the purposes of the present invention, the terms "quantity" or "content" (of MUC17) may be used interchangeably with the terms "level", "amount" or "concentration" (of MUC17). The "pre-defined value for the MUC17 content" may be a "cut-off value" which has been pre-determined. This value can e.g. indicate that a certain MUC17 content in a sample is indicative for a disease associated with MUC17 or increased MUC17, or a MUC17 positive neoplasm. For example, if the MUC17 content in a sample is determined to be three standard deviations above the predetermined cut-off value, the subject from which the sample was obtained is considered positive gastrointestinal cancer (or other diseases as described herein). The "control sample" is usually obtained from a source of the same nature as the sample to be analyzed. The control sample may be a sample ("negative control sample") representing a "normal" MUC17 content (e.g. representing a healthy subject), or it may be a sample ("positive control sample") representing an "abnormally increased" MUC17 content (e.g. representing a subject having a disease as defined herein).

In a further aspect, the present invention provides a method for diagnosing a disease associated with MUC17 or increased MUC17, comprising the steps of:

(a) using an antibody of the present invention, or using a detection system of the present invention, for determining the content of MUC17 in a sample; and (b) comparing the content of MUC17 determined in step (a) to (i) a pre-defined cut-off value for the MUC17 content, indicating absence of such disease, or (ii) the content of MUC17 determined in a control sample representing absence of such disease, wherein a higher content of MUC17 determined in step (a) as compared to the pre-defined cut-off value of (i) or the content of MUC17 determined in the control sample of (ii) indicates the presence of a disease associated with MUC17 or increased MUC17.

In a further aspect, the present invention also provides a method for monitoring the progression of a disease associated with MUC17 or increased MUC17 or for monitoring the response to treatment of a disease associated with MUC17 or increased MUC17, comprising the steps of:

(a) using an antibody of the present invention, or using a detection system of the present invention, for determining the content of MUC17 at a first time point in a biological sample obtained from a subject diagnosed with such disease;

(b) using an antibody of the present invention, or using a detection system of the present invention, for determining the content of MUC17 at a second (later) time point or after treatment in a biological sample obtained from the subject; and (c) comparing the content of MUC17 determined in step (a) to the content of MUC17 determined in step (b);

wherein a higher content of MUC17 determined in step (a) as compared to the content of MUC17 determined in step (b) indicates that the disease is progressing, and/or wherein a lower content of MUC17 determined in step (a) as compared to the content of MUC17 determined in step (b) indicates that said disease is entering remission or that said disease is responding to the treatment.

It is envisaged for the above methods that the "sample" is a biological sample, such as a human biological sample. The sample may be a (human) tissue sample, or a cell culture of (human) The "sample" may also be obtained from a human subject, preferably a human subject suspected of having or having (being diagnosed with) a disease associated with MUC17 or increased MUC17, or a subject having received treatment for a disease associated with MUC17 or increased MUC17, as defined above.

It is envisaged for the above methods, that the "disease associated with MUC17 or increased MUC17" may be a MUC17 positive neoplasm. The disease or the MUC17 positive neoplasm may be selected from the group gastric cancer, esophageal cancer, gastroesophageal cancer (including gastroesophageal junction cancer), gastrointestinal cancer, and pancreas cancer.

The present invention also contemplates the following items:

Item 1. A monoclonal antibody that either binds or does not bind to soluble MUC17 (MUC17), wherein the binding of the antibody to MUC17 occurs in the presence of a second monoclonal antibody binding to MUC17.

Item 2. The monoclonal antibody according to item 1, wherein MUC17 has the amino acid sequence as depicted in SEQ ID NO: 1.

Item 3. The monoclonal antibody according to item 1 or 2, wherein the binding of the monoclonal antibody to MUC17 occurs in the presence of a third antibody binding to MUC17.

Item 4: The monoclonal antibody according to any of the preceding items, wherein the monoclonal antibody comprises a rodent, e.g. a mouse or rabbit VH region and/or VL region.

Item 5. The monoclonal antibody according to any one of the preceding items, wherein the monoclonal antibody has an affinity (KD) to MUC17 of about $\leq 10^{-7}$ M, $\leq 10^{--8}$ M, $\leq 10^{-9}$ M, or $\leq 10^{-10}$ M.

Item 6. The monoclonal antibody according to item 5, wherein the affinity is determined in a Biacore assay.

Item 7. The monoclonal antibody according to any one of the preceding items, wherein the monoclonal antibody:

a) comprises a VH region comprising a VH-CDR1 as depicted in SEQ ID NO: 2, a VH-CDR2 as depicted in SEQ ID NO: 3, and a VH-CDR3 as depicted in SEQ ID NO: 4, and a VL region comprising a VL-CDR1 as depicted in SEQ ID NO: 6, a VL-CDR2 as depicted in SEQ ID NO: 7, and a VL-CDR3 as depicted in SEQ ID NO: 8;

b) binds to the same MUC17 epitope as the antibody of a) or competes for binding to MUC17 with the antibody of a);

c) binds to the same MUC17 epitope as the antibody of b) or competes for binding to MUC17 with the antibody of b); or d) binds to the same MUC17 epitope as the antibody of c) or competes for binding to MUC17 with the antibody of c).

Item 8. The monoclonal antibody according to item 7, comprising a) a VH region comprising an amino acid sequence which is at least 60%, 65% or 70%, preferably at least 75% or 80%, more preferably at least 85%, 90%, 91%, 92%, 93%, 94%, and most preferably 95%, 96%, 97%, 98%, or 99% homologous to the VH region comprised in SEQ ID NO: 5; and a VL region comprising an amino acid sequence which is at least 60%, 65% or 70%, preferably at least 75% or 80%, more preferably at least 85%, 90%, 91%, 92%, 93%, 94%, and most preferably 95%, 96%, 97%, 98%, or 99% homologous to the VL region comprised in SEQ ID NO: 9; and optionally comprising a VH-CDR1 as depicted in SEQ ID NO: 2, a VH-CDR2 as depicted in SEQ ID NO: 3, and a VH-CDR3 as depicted in SEQ ID NO: 4, and optionally comprising a VL-CDR1 as depicted in SEQ ID NO: 6, a VL-CDR2 as depicted in SEQ ID NO: 7, and a VL-CDR3 as depicted in SEQ ID NO: 8;

Item 9. The monoclonal antibody according to item 7, wherein the monoclonal antibody:

a) comprises a VH region comprised in SEQ ID NO: 5;

b) comprises a VL region comprised in SEQ ID NO: 9;

c) comprises a VH region comprised in SEQ ID NO: 5 and a VL region comprised in SEQ ID NO: 9;

d) binds to the same MUC17 epitope as the antibody of c) or competes for binding to MUC17 with the antibody of c);

e) binds to the same MUC17 epitope as the antibody of d) or competes for binding to MUC17 with the antibody of d); or f) binds to the same MUC17 epitope as the antibody of e) or competes for binding to MUC17 with the antibody of e).

Item 10. The monoclonal antibody according to any one of items 6 to 9, wherein the binding to the MUC17 epitope is determined via epitope mapping with chimeric or mutated MUC17 molecules, site-directed mutagenesis (e.g. alanine scanning), high-throughput shotgun mutagenesis epitope mapping, cross-linking-coupled mass spectrometry, X-ray co-crystallography, cryogenic electron microscopy, and hydrogen-deuterium exchange.

Item 11. The monoclonal antibody according to any one of items 6 to 9, wherein the competition for binding to MUC17 is determined in a competitive ELISA assay, in an Octet competition assay or in a competition assay using avidin-coupled microparticles.

Item 12. The monoclonal antibody according to any one of items 6 to 9 or 11, wherein the competition for binding to MUC17 is defined as a competition occurring between the two tested antibodies of at least 20%, at least 30%, at least 40%, at least 50%, at least 60%, at least 70%, at least 80% or at least 90%.

Item 13. The monoclonal antibody according to any one of the preceding items, which is an IgG, IgD, IgE, IgM or IgA antibody, preferably an IgG antibody, such as an IgG1, IgG2, IgG3 or IgG4 antibody.

Item 14. The monoclonal antibody according to any one of the preceding items, wherein the monoclonal antibody and/or the second monoclonal antibody bind(s) to MUC17 in a biological sample, preferably a human biological sample, such as a (human) serum sample, a (human) plasma sample, a (human) blood sample, a (human) bone marrow sample, a (human) tissue sample, particularly a tissue sample derived from the stomach, gastrointestinal tract, esophagus, gastroesophagus including the gastroesophageal junction, and the pancreas.

Item 15. A polynucleotide encoding a monoclonal antibody as defined in any one of the preceding items.

Item 16. A vector comprising the polynucleotide as defined in item 15.

Item 17. A host cell transformed or transfected with the polynucleotide as defined in item 15 or with the vector as defined in item 16.

Item 18. A process for producing a monoclonal antibody as defined in any one of items 1 to 14, said process comprising culturing a host cell as defined in item 17 under conditions allowing the expression of said monoclonal antibody and recovering the produced monoclonal antibody from the culture.

Item 19. A composition comprising a monoclonal antibody as defined in any one of items 1 to 14 or produced according to the process of item 18.

Item 20. A detection system comprising a) a first monoclonal antibody which binds to MUC17, and b) a second monoclonal antibody a first monoclonal to MUC17, wherein the binding of the first monoclonal antibody to MUC17 occurs in the presence of the second monoclonal antibody binding to MUC17, and/or wherein the binding of the second monoclonal antibody to MUC17 occurs in the presence of the first monoclonal antibody binding to MUC17.

Item 21. The detection system according to item 20, wherein MUC17 has the amino acid sequence as depicted in SEQ ID NO: 1.

Item 22. The detection system according to item 20 or 21, wherein the binding of the first monoclonal antibody to MUC17 and the binding of the second monoclonal antibody to MUC17 occur in the presence of a third antibody or binding to MUC17.

Item 23. The detection system according to any one of items 20 to 23, wherein the first monoclonal antibody and/or the second monoclonal antibody comprise(s) a mouse VH region and/or a mouse VL region.

Item 24. The detection system according to any one of items 20 to 23, wherein the first monoclonal antibody and/or the second monoclonal antibody has an affinity (KD) to MUC17 of about $\leq 10^{-7}$ M, $\leq 10^{-8}$ M, $\leq 10^{-9}$ M, or $\leq 10^{-10}$ M.

Item 25. The detection system according to any one of items 20 to 24, wherein the first monoclonal antibody:

a) comprises a VH region comprising a VH-CDR1 as depicted in SEQ ID NO: 2, a VH-CDR2 as depicted in SEQ ID NO: 3, and a VH-CDR3 as depicted in SEQ ID NO: 4, and a VL region comprising a VL-CDR1 as depicted in SEQ ID NO: 6, a VL-CDR2 as depicted in SEQ ID NO: 7, and a VL-CDR3 as depicted in SEQ ID NO: 8; or b) binds to the same MUC17 epitope as the antibody of a) or b) or competes for binding to MUC17 with the antibody of a).

Item 26. The detection system according to any one of items 20 to 26, wherein the first monoclonal antibody and/or the second monoclonal antibody is/are an IgG, IgD, IgE, IgM or IgA antibody, preferably an IgG antibody, such as an IgG1, IgG2, IgG3 or IgG4 antibody.

Item 27. The detection system according to any one of items 20 to 26, wherein the first monoclonal antibody is used as capture antibody, and a second monoclonal antibody is used as detection antibody, or wherein the first monoclonal antibody is used as detection antibody, and the second monoclonal antibody is used as capture antibody.

Item 28. Use of a monoclonal antibody of any one of items 1 to 14 or of the detection system of any one of items 20 to 27 for:

detecting MUC17 in a sample;

quantifying MUC17 in a sample;

diagnosing a disease associated with MUC17 or increased MUC17;

stratifying patients diagnosed with a disease associated with MUC17 or increased MUC17;

monitoring the progression of a disease associated with MUC17 or increased MUC17; or monitoring the response to treatment of a disease associated with MUC17 or increased MUC17.

Item 29. A method for detecting and/or quantifying MUC17 in a sample, comprising the steps of:

(a) using a monoclonal antibody (or derivative) of any one of items 1 to 14, or using a detection system of any one of items 20 to 27, for determining the content of MUC17 in a sample; and (b) comparing the content of MUC17 determined in step (a) to (i) a pre-defined value for the MUC17 content, (ii) the content of MUC17 determined in a control sample, or (iii) the content of MUC17 determined in a sample obtained from the same source or subject at a previous time point.

Item 30. A method for diagnosing a disease associated with MUC17 or increased MUC17, comprising the steps of (a) using a monoclonal antibody of any one of items 1 to 14, or using a detection system of any one of items 20 to 27, for determining the content of MUC17 in a sample, preferably in a tissue sample for IHC; and (b) comparing the content of MUC17 determined in step (a) to (i) a pre-defined cut-off value for the MUC17 content, indicating absence of such disease, or (ii) the content of MUC17 determined in a control sample representing absence of such disease, wherein a higher content of MUC17 determined in step (a) as compared to the pre-defined cut-off value of (i) or the content of MUC17 determined in the control sample of (ii) indicates the presence of a disease associated with MUC17 or increased MUC17.

Item 31. A method for monitoring the progression of a disease associated with MUC17 or increased MUC17 or for monitoring the response to treatment of a disease associated with MUC17 or increased MUC17, comprising the steps of:

(a) using a monoclonal antibody of any one of items 1 to 14, or using a detection system of any one of items 20 to 28, for determining the content of MUC17 at a first time point in a biological sample obtained from a subject diagnosed with such disease;

(b) using a monoclonal antibody of any one of items 1 to 14, or using a detection system of any one of items 20 to 28, for determining the content of MUC17 at a second time point or after treatment in a biological sample obtained from the subject; and (c) comparing the content of MUC17 determined in step (a) to the content of MUC17 determined in step (b);

wherein a higher content of MUC17 determined in step (a) as compared to the content of MUC17 determined in step (b) indicates that the disease is progressing, and/or wherein a lower content of MUC17 determined in step (a) as compared to the content of MUC17 determined in step (b) indicates that said disease is entering remission or that said disease is responding to the treatment.

Item 32. The use of item 28 or the method of any one of items 29 to 31, wherein the sample is a biological sample, preferably a human biological sample, such as a serum sample, a plasma sample, a blood sample, a bone marrow sample, a tissue sample, or supernatant obtained from a cell culture of bone marrow mononuclear cells or peripheral blood mononuclear cells, preferably a tissue sample.

Item 33. The use of item 28 or 32 or the method of any one of items 29 to 32, wherein the sample is obtained from a human subject, preferably a human subject suspected of having or having a disease associated with MUC17 or increased MUC17, or a subject having received treatment for a disease associated with MUC17 or increased MUC17.

Item 34. The use of any one of items 29, 32 or 33 or the method of any one of items 29 to 33, wherein the disease is selected from the group consisting of gastric cancer, esophageal cancer, gastroesophageal cancer including gastroesophageal junction cancer, gastrointestinal cancer, and pancreas cancer.

Item 35. A method of treatment of a patient, preferably a human patient, having at least one cancer selected from the group comprising esophageal cancer, gastric cancer, gastrointestinal cancer, gastroesophageal cancer, including gastroesophageal junction cancer, and/or pancreas cancer, wherein said patient has an increased expression of MUC17 on a cancer cell, particularly a cell of a colorectal carcinoma, a gastric carcinoma, a pancreatic carcinoma, colon adenocarcinoma, esophageal carcinoma, pancreatic adenocarcinoma, rectum adenocarcinoma, and stomach adenocarcinoma.

Item 36. The method of treatment according to item 35, wherein said increased expression was determined in a method according to any one of items 29-31, or wherein the use or the product for use of any one of items referred to above relating to diagnostic antibodies or compositions comprising the same or a drug is comprised.

Item 37. The method of treatment according to item 35 and 36 comprising the administration of a drug to said patient, wherein the drug is selected from the group comprising small molecules, peptidic drugs, antibodies and derivatives thereof, toxins, radiation therapy, and surgery.

Item 38. The method of treatment according to any one of items 35 to 37, wherein the drug is an antibody construct comprising at least two domains, wherein one domain binds selectively to MUC17.

Item 39. The method of treatment according to any one of items 35 to 38, wherein the drug is an antibody construct comprising at least two domains, wherein another domain binds selectively to CD3, to human CD3, particularly to the human CD3 Epsilon chain.

Item 40. The method of treatment according to any one of items 35 to 39, wherein the drug is an antibody construct further comprising a third domain which comprises two polypeptide monomers, each comprising a hinge, a CH2 domain and a CH3 domain, wherein said two polypeptide monomers are fused to each other via a peptide linker.

Item 41. The method of treatment according to any one of items 35 to 40, wherein the drug is a single chain antibody construct.

Item 42. The method of treatment according to any one of items 35 to 41, wherein the drug is an antibody construct, wherein said third domain comprises in an amino to carboxyl order: hinge-CH2-CH3-linker-hinge-CH2-CH3.

Item 43. The method of treatment according to any one of items 35 to 42, wherein the drug is an antibody construct, wherein each of said polypeptide monomers in the third domain has an amino acid sequence that is at least 90% identical to a sequence selected from the group from the group consisting of: SEQ ID NO: 22-29.

Item 44. The method of treatment according to any one of items 35 to 43, wherein the drug is an antibody construct, wherein each of said polypeptide monomers has an amino acid sequence selected from SEQ ID NO: 22-29.

Item 45. The method of treatment according to any one of items 35 to 44, wherein the drug is an antibody construct, wherein the CH2 domain comprises an intra domain cysteine disulfide bridge.

Item 46. The method of treatment according to any one of items 35 to 45, wherein the drug is an antibody construct, wherein (i) the first domain comprises two antibody variable domains and the second domain comprises two antibody variable domains; (ii) the first domain comprises one antibody variable domain and the second domain comprises two antibody variable domains; (iii) the first domain comprises two antibody variable domains and the second domain comprises one antibody variable domain; or (iv) the first domain comprises one antibody variable domain and the second domain comprises one antibody variable domain.

Item 47. The method of treatment according to any one of items 35 to 46, wherein the drug is an antibody construct, wherein the first and second domain are fused to the third domain via a peptide linker.

Item 48. The method of treatment according to any one of items 35 to 47, wherein the drug is an antibody construct, wherein the antibody construct comprises in an amino to carboxyl order: (a) the first domain; (b) a peptide linker preferably having an amino acid sequence selected from the group consisting of SEQ ID NOs: 10-12; (c) the second domain.

Item 49. The method of treatment according to any one of items 35 to 48, wherein the drug is an antibody construct, wherein the antibody construct further comprises in an amino to carboxyl order: (d) a peptide linker having an amino acid sequence selected from the group consisting of SEQ ID NOs: 10, 11, 12, 17, 18, 19 and 20; (e) the first polypeptide monomer of the third domain; (f) a peptide linker having an amino acid sequence selected from the group consisting of SEQ ID NOs: 13, 14, 15 and 16; and (g) the second polypeptide monomer of the third domain.

Item 50. The method of treatment according to any one of items 35 to 49, wherein the drug is an antibody construct, wherein the first domain of the antibody construct binds to an epitope within MUC17 which corresponds to SEQ ID NO. 526 (aa 4171 to 4296 according to uniprot Q685J3 numbering).

Item 51. The method of treatment according to any one of items 35 to 50, wherein the drug is an antibody construct, wherein the first domain of the antibody construct binds to an epitope within MUC17 which corresponds to SEQ ID NO. 527 (aa 4184 to 4291 according to uniprot Q685J3 numbering).

Item 52. The method of treatment according to any one of items 35 to 51, wherein the drug is an antibody construct, wherein the first domain of the antibody construct binds to an epitope within MUC17 which corresponds to SEQ ID NO. 528 (aa 4131 to 4243 according to uniprot Q685J3 numbering).

Item 53. The method of treatment according to any one of items 35 to 52, wherein the drug is an antibody construct, wherein the first domain of the antibody construct binds to an epitope within MUC17 which corresponds to SEQ ID NO. 529 (aa 4244 to 4389 according to uniprot Q685J3 numbering).

Item 54. The method of treatment according to any one of items 35 to 53, wherein the drug is an antibody construct, wherein the first domain of the antibody construct binds to an epitope within MUC17 which corresponds to SEQ ID NO. 528 (aa 4131 to 4243 according to uniprot Q685J3 numbering) but not to an epitope within MUC17 which corresponds to SEQ ID NO. 529 (aa 4244 to 4389 according to uniprot Q685J3 numbering).

Item 55. The method of treatment according to any one of items 35 to 54, wherein the drug is an antibody construct, wherein the first domain of the antibody construct binds to an epitope within MUC17 which corresponds to SEQ ID NO. 530 (aa 4171 to 4390 according to uniprot Q685J3 numbering) or SEQ ID NO. 531 (aa 4184 to 4390 according to uniprot Q685J3 numbering) but not to an epitope within MUC17 which corresponds to SEQ ID NO. 532 (aa 4291 to 4390 according to uniprot Q685J3 numbering) or to an epitope within MUC17 which corresponds to SEQ ID NO. 533 (aa 4341 to 4390 according to uniprot Q685J3 numbering).

Item 56. The method of treatment according to any one of items 35 to 55, wherein the drug is an antibody construct, wherein the ratio between cytotoxicity and binding affinity (EC50/KD)*1000 is below 250, wherein the cytotoxicity is determined in NUGC-4 cells as target cells and huPBMC as effector cells, and wherein the binding affinity is determined by a surface plasmon resonance-based assay.

Item 57. The method of treatment according to any one of items 35 to 56, wherein the drug is an antibody construct, wherein the ratio between cytotoxicity and binding affinity (EC50/KD)*1000 is below 125, wherein the cytotoxicity is determined in NUGC-4 cells as target cells and huPBMC as effector cells, and wherein the binding affinity is determined by a surface plasmon resonance-based assay.

Item 58. The method of treatment according to any one of items 35 to 57, wherein the drug is an antibody construct, wherein the ratio between cytotoxicity and binding affinity (EC50/KD)*1000 is below 21, wherein the cytotoxicity is determined in NUGC-4 cells as target cells and huPBMC as effector cells, and wherein the binding affinity is determined by a surface plasmon resonance-based assay.

Item 59. The method of treatment according to any one of items 35 to 58, wherein the drug is an antibody construct, wherein the first binding domain comprises a VH region comprising CDR-H 1, CDR-H2 and CDR-H3 selected from: (a) CDR-H1 as depicted in SEQ ID NO. 31, CDR-H2 as depicted in SEQ ID NO. 32 and CDR-H3 as depicted in SEQ ID NO. 33; (b) CDR-H1 as depicted in SEQ ID NO. 42, CDR-H2 as depicted in SEQ ID NO. 43 and CDR-H3 as depicted in SEQ ID NO. 44; (c) CDR-H1 as depicted in SEQ ID NO. 53, CDR-H2 as depicted in SEQ ID NO. 54 and CDR-H3 as depicted in SEQ ID NO. 55; (d) CDR-H1 as depicted in SEQ ID NO. 64, CDR-H2 as depicted in SEQ ID NO. 65 and CDR-H3 as depicted in SEQ ID NO. 66; (e) CDR-H1 as depicted in SEQ ID NO. 75, CDR-H2 as depicted in SEQ ID NO. 76 and CDR-H3 as depicted in SEQ ID NO. 77; (f) CDR-H1 as depicted in SEQ ID NO. 86, CDR-H2 as depicted in SEQ ID NO. 87 and CDR-H3 as depicted in SEQ ID NO. 88; (g) CDR-H1 as depicted in SEQ ID NO. 97, CDR-H2 as depicted in SEQ ID NO. 98 and CDR-H3 as depicted in SEQ ID NO. 99; (h) CDR-H1 as depicted in SEQ ID NO. 108, CDR-H2 as depicted in SEQ ID NO. 109 and CDR-H3 as depicted in SEQ ID NO. 110; (i) CDR-H1 as depicted in SEQ ID NO. 119, CDR-H2 as depicted in SEQ ID NO. 120 and CDR-H3 as depicted in SEQ ID NO. 121; (j) CDR-H1 as depicted in SEQ ID NO. 130, CDR-H2 as depicted in SEQ ID NO. 131 and CDR-H3 as depicted in SEQ ID NO. 132; (k) CDR-H1 as depicted in SEQ ID NO. 141, CDR-H2 as depicted in SEQ ID NO. 142 and CDR-H3 as depicted in SEQ ID NO. 143; (1) CDR-H1 as depicted in SEQ ID NO. 152, CDR-H2 as depicted in SEQ ID NO. 153 and CDR-H3 as depicted in SEQ ID NO. 154; (m) CDR-H1 as depicted in SEQ ID NO. 163, CDR-H2 as depicted in SEQ ID NO. 164 and CDR-H3 as depicted in SEQ ID NO. 165; (n) CDR-H1 as depicted in SEQ ID NO. 174, CDR-H2 as depicted in SEQ ID NO. 175 and CDR-H3 as depicted in SEQ ID NO. 176; (o) CDR-H1 as depicted in SEQ ID NO. 185, CDR-H2 as depicted in SEQ ID NO. 186 and CDR-H3 as depicted in SEQ ID NO. 187; (p) CDR-H1 as depicted in SEQ ID NO. 196, CDR-H2 as depicted in SEQ ID NO. 197 and CDR-H3 as depicted in SEQ ID NO. 198; (q) CDR-H1 as depicted in SEQ ID NO. 207, CDR-H2 as depicted in SEQ ID NO. 208 and CDR-H3 as depicted in SEQ ID NO. 209; (r) CDR-H1 as depicted in SEQ ID NO. 218, CDR-H2 as depicted in SEQ ID NO. 219 and CDR-H3 as depicted in SEQ ID NO. 220; (s) CDR-H1 as depicted in SEQ ID NO. 229, CDR-H2 as depicted in SEQ ID NO. 230 and CDR-H3 as depicted in SEQ ID NO. 231; (t) CDR-H1 as depicted in SEQ ID NO. 240, CDR-H2 as depicted in SEQ ID NO. 241 and CDR-H3 as depicted in SEQ ID NO. 242; (u) CDR-H1 as depicted in SEQ ID NO. 251, CDR-H2 as depicted in SEQ ID NO. 252 and CDR-H3 as depicted in SEQ ID NO. 253; (v) CDR-H1 as depicted in SEQ ID NO. 262, CDR-H2 as depicted in SEQ ID NO. 263 and CDR-H3 as depicted in SEQ ID NO. 264; (w) CDR-H1 as depicted in SEQ ID NO. 273, CDR-H2 as depicted in SEQ ID NO. 274 and CDR-H3 as depicted in SEQ ID NO. 275; (x) CDR-H1 as depicted in SEQ ID NO. 284, CDR-H2 as depicted in SEQ ID NO. 285 and CDR-H3 as depicted in SEQ ID NO. 286; (y) CDR-H1 as depicted in SEQ ID NO. 295, CDR-H2 as depicted in SEQ ID NO. 296 and CDR-H3 as depicted in SEQ ID NO. 297; (z) CDR-H1 as depicted in SEQ ID NO. 306, CDR-H2 as depicted in SEQ ID NO. 307 and CDR-H3 as depicted in SEQ ID NO. 308; (aa) CDR-H1 as depicted in SEQ ID NO. 317, CDR-H2 as depicted in SEQ ID NO. 318 and CDR-H3 as depicted in SEQ ID NO. 319; (ab) CDR-H1 as depicted in SEQ ID NO. 328, CDR-H2 as depicted in SEQ ID NO. 329 and CDR-H3 as depicted in SEQ ID NO. 330; (ac) CDR-H1 as depicted in SEQ ID NO. 339, CDR-H2 as depicted in SEQ ID NO. 340 and CDR-H3 as depicted in SEQ ID NO. 341; (ad) CDR-H1 as depicted in SEQ ID NO. 350, CDR-H2 as depicted in SEQ ID NO. 351 and CDR-H3 as depicted in SEQ ID NO. 352; (ae) CDR-H1 as depicted in SEQ ID NO. 361, CDR-H2 as depicted in SEQ ID NO. 362 and CDR-H3 as depicted in SEQ ID NO. 363; (af) CDR-H1 as depicted in SEQ ID NO. 372, CDR-H2 as depicted in SEQ ID NO. 373 and CDR-H3 as depicted in SEQ ID NO. 374; (ag) CDR-H1 as depicted in SEQ ID NO. 383, CDR-H2 as depicted in SEQ ID NO. 384 and CDR-H3 as depicted in SEQ ID NO. 385; (ah) CDR-H1 as depicted in SEQ ID NO. 394, CDR-H2 as depicted in SEQ ID NO. 395 and CDR-H3 as depicted in SEQ ID NO. 396; (ai) CDR-H1 as depicted in SEQ ID NO. 405, CDR-H2 as depicted in SEQ ID NO. 406 and CDR-H3 as depicted in SEQ ID NO. 407; (aj) CDR-H1 as depicted in SEQ ID NO. 416, CDR-H2 as depicted in SEQ ID NO. 417 and CDR-H3 as depicted in SEQ ID NO. 418; (ak) CDR-H1 as depicted in SEQ ID NO. 427, CDR-H2 as depicted in SEQ ID NO. 428 and CDR-H3 as depicted in SEQ ID NO. 429; (al) CDR-H1 as depicted in SEQ ID NO. 438, CDR-H2 as depicted in SEQ ID NO. 439 and CDR-H3 as depicted in SEQ ID NO. 440; (am) CDR-H1 as depicted in SEQ ID NO. 449, CDR-H2 as depicted in SEQ ID NO. 450 and CDR-H3 as depicted in SEQ ID NO. 451; (an) CDR-H1 as depicted in SEQ ID NO. 460, CDR-H2 as depicted in SEQ ID NO. 461 and CDR-H3 as depicted in SEQ ID NO. 462; (ao) CDR-H1 as depicted in SEQ ID NO. 471, CDR-H2 as depicted in SEQ ID NO. 472 and CDR-H3 as depicted in SEQ ID NO. 473; (ap) CDR-H1 as depicted in SEQ ID NO. 482, CDR-H2 as depicted in SEQ ID NO. 483 and CDR-H3 as depicted in SEQ ID NO. 484; (aq) CDR-H1 as depicted in SEQ ID NO. 493, CDR-H2 as depicted in SEQ ID NO. 494 and CDR-H3 as depicted in SEQ ID NO. 495; (ar) CDR-H1 as depicted in SEQ ID NO. 504, CDR-H2 as depicted in SEQ ID NO. 505 and CDR-H3 as depicted in SEQ ID NO. 506; and (as) CDR-H1 as depicted in SEQ ID NO. 515, CDR-H2 as depicted in SEQ ID NO. 516 and CDR-H3 as depicted in SEQ ID NO. 517; wherein preferred are (c) CDR-H1 as depicted in SEQ ID NO. 53, CDR-H2 as depicted in SEQ ID NO. 54 and CDR-H3 as depicted in SEQ ID NO. 55; (n) CDR-H1 as depicted in SEQ ID NO. 174, CDR-H2 as depicted in SEQ ID NO. 175 and CDR-H3 as depicted in SEQ ID NO. 176; (ac) CDR-H1 as depicted in SEQ ID NO. 339, CDR-H2 as depicted in SEQ ID NO. 340 and CDR-H3 as depicted in SEQ ID NO. 341; and (aj) CDR-H1 as depicted in SEQ ID NO. 416, CDR-H2 as depicted in SEQ ID NO. 417 and CDR-H3 as depicted in SEQ ID NO. 418.

60. The method of treatment according to any one of items 35 to 59, wherein the drug is an antibody construct, wherein the first binding domain comprises a VL region comprising CDR-H1, CDR-L2 and CDR-L3 selected from: (a) CDR-L1 as depicted in SEQ ID NO. 34, CDR-L2 as depicted in SEQ ID NO. 35 and CDR-L3 as depicted in SEQ ID NO. 36; (b) CDR-L1 as depicted in SEQ ID NO. 45, CDR-L2 as depicted in SEQ ID NO. 46 and CDR-L3 as depicted in SEQ ID NO. 47; (c) CDR-L1 as depicted in SEQ ID NO. 56, CDR-L2 as depicted in SEQ ID NO. 57 and CDR-L3 as depicted in SEQ ID NO. 58; (d) CDR-L1 as depicted in SEQ ID NO. 67, CDR-L2 as depicted in SEQ ID NO. 68 and CDR-L3 as depicted in SEQ ID NO. 69; (e) CDR-L1 as depicted in SEQ ID NO. 78, CDR-L2 as depicted in SEQ ID NO. 79 and CDR-L3 as depicted in SEQ ID NO. 80; (f) CDR-L1 as depicted in SEQ ID NO. 89, CDR-L2 as depicted in SEQ ID NO. 90 and CDR-L3 as depicted in SEQ ID NO. 91; (g) CDR-L1 as depicted in SEQ ID NO. 100, CDR-L2 as depicted in SEQ ID NO. 101 and CDR-L3 as depicted in SEQ ID NO. 102; (h) CDR-L1 as depicted in SEQ ID NO. 111, CDR-L2 as depicted in SEQ ID NO. 112 and CDR-L3 as depicted in SEQ ID NO. 113; (i) CDR-L1 as depicted in SEQ ID NO. 122, CDR-L2 as depicted in SEQ ID NO. 123 and CDR-L3 as depicted in SEQ ID NO. 124; (j) CDR-L1 as depicted in SEQ ID NO. 133, CDR-L2 as depicted in SEQ ID NO. 134 and CDR-L3 as depicted in SEQ ID NO. 135; (k) CDR-L1 as depicted in SEQ ID NO. 144, CDR-L2 as depicted in SEQ ID NO. 145 and CDR-L3 as depicted in SEQ ID NO. 146; (1) CDR-L1 as depicted in SEQ ID NO. 155, CDR-L2 as depicted in SEQ ID NO. 156 and CDR-L3 as depicted in SEQ ID NO. 157; (m) CDR-L1 as depicted in SEQ ID NO. 166, CDR-L2 as depicted in SEQ ID NO. 167 and CDR-L3 as depicted in SEQ ID NO. 168; (n) CDR-L1 as depicted in SEQ ID NO. 177, CDR-L2 as depicted in SEQ ID NO. 178 and CDR-L3 as depicted in SEQ ID NO. 179; (o) CDR-L1 as depicted in SEQ ID NO. 188, CDR-L2 as depicted in SEQ ID NO. 189 and CDR-L3 as depicted in SEQ ID NO. 190; (p) CDR-L1 as depicted in SEQ ID NO. 199, CDR-L2 as depicted in SEQ ID NO. 200 and CDR-L3 as depicted in SEQ ID NO. 201; (q) CDR-L1 as depicted in SEQ ID NO. 210, CDR-L2 as depicted in SEQ ID NO. 211 and CDR-L3 as depicted in SEQ ID NO. 212; (r) CDR-L1 as depicted in SEQ ID NO. 221, CDR-L2 as depicted in SEQ ID NO. 222 and CDR-L3 as depicted in SEQ ID NO. 223; (s) CDR-L1 as depicted in SEQ ID NO. 232, CDR-L2 as depicted in SEQ ID NO. 233 and CDR-L3 as depicted in SEQ ID NO. 234; (t) CDR-L1 as depicted in SEQ ID NO. 243, CDR-L2 as depicted in SEQ ID NO. 244 and CDR-L3 as depicted in SEQ ID NO. 245; (u) CDR-L1 as depicted in SEQ ID NO. 254, CDR-L2 as depicted in SEQ ID NO. 255 and CDR-L3 as depicted in SEQ ID NO. 256; (v) CDR-L1 as depicted in SEQ ID NO. 265, CDR-L2 as depicted in SEQ ID NO. 266 and CDR-L3 as depicted in SEQ ID NO. 267; (w) CDR-L1 as depicted in SEQ ID NO. 276, CDR-L2 as depicted in SEQ ID NO. 277 and CDR-L3 as depicted in SEQ ID NO. 278; (x) CDR-L1 as depicted in SEQ ID NO. 287, CDR-L2 as depicted in SEQ ID NO. 288 and CDR-L3 as depicted in SEQ ID NO. 289; (y) CDR-L1 as depicted in SEQ ID NO. 298, CDR-L2 as depicted in SEQ ID NO. 299 and CDR-L3 as depicted in SEQ ID NO. 300; (z) CDR-L1 as depicted in SEQ ID NO. 309, CDR-L2 as depicted in SEQ ID NO. 310 and CDR-L3 as depicted in SEQ ID NO. 311; (aa) CDR-L1 as depicted in SEQ ID NO. 320, CDR-L2 as depicted in SEQ ID NO. 321 and CDR-L3 as depicted in SEQ ID NO. 322; (ab) CDR-L1 as depicted in SEQ ID NO. 331, CDR-L2 as depicted in SEQ ID NO. 332 and CDR-L3 as depicted in SEQ ID NO. 333; (ac) CDR-L1 as depicted in SEQ ID NO. 342, CDR-L2 as depicted in SEQ ID NO. 343 and CDR-L3 as depicted in SEQ ID NO. 344; (ad) CDR-L1 as depicted in SEQ ID NO. 353, CDR-L2 as depicted in SEQ ID NO. 354 and CDR-L3 as depicted in SEQ ID NO. 355; (ae) CDR-L1 as depicted in SEQ ID NO. 364, CDR-L2 as depicted in SEQ ID NO. 365 and CDR-L3 as depicted in SEQ ID NO. 366; (af) CDR-L1 as depicted in SEQ ID NO. 375, CDR-L2 as depicted in SEQ ID NO. 376 and CDR-L3 as depicted in SEQ ID NO. 377; (ag) CDR-L1 as depicted in SEQ ID NO. 386, CDR-L2 as depicted in SEQ ID NO. 387 and CDR-L3 as depicted in SEQ ID NO. 388; (ah) CDR-L1 as depicted in SEQ ID NO. 397, CDR-L2 as depicted in SEQ ID NO. 398 and CDR-L3 as depicted in SEQ ID NO. 399; (ai) CDR-L1 as depicted in SEQ ID NO. 408, CDR-L2 as depicted in SEQ ID NO. 409 and CDR-L3 as depicted in SEQ ID NO. 410; (aj) CDR-L1 as depicted in SEQ ID NO. 419, CDR-L2 as depicted in SEQ ID NO. 420 and CDR-L3 as depicted in SEQ ID NO. 421; (ak) CDR-L1 as depicted in SEQ ID NO. 430, CDR-L2 as depicted in SEQ ID NO. 431 and CDR-L3 as depicted in SEQ ID NO. 432; (al) CDR-L1 as depicted in SEQ ID NO. 441, CDR-L2 as depicted in SEQ ID NO. 442 and CDR-L3 as depicted in SEQ ID NO. 443; (am) CDR-L1 as depicted in SEQ ID NO. 452, CDR-L2 as depicted in SEQ ID NO. 453 and CDR-L3 as depicted in SEQ ID NO. 454; (an) CDR-L1 as depicted in SEQ ID NO. 463, CDR-L2 as depicted in SEQ ID NO. 464 and CDR-L3 as depicted in SEQ ID NO. 465; (ao) CDR-L1 as depicted in SEQ ID NO. 474, CDR-L2 as depicted in SEQ ID NO. 475 and CDR-L3 as depicted in SEQ ID NO. 476; (ap) CDR-L1 as depicted in SEQ ID NO. 485, CDR-L2 as depicted in SEQ ID NO. 486 and CDR-L3 as depicted in SEQ ID NO. 487; (aq) CDR-L1 as depicted in SEQ ID NO. 496, CDR-L2 as depicted in SEQ ID NO. 497 and CDR-L3 as depicted in SEQ ID NO. 498; (ar) CDR-L1 as depicted in SEQ ID NO. 507, CDR-L2 as depicted in SEQ ID NO. 508 and CDR-L3 as depicted in SEQ ID NO. 509; and (as) CDR-L1 as depicted in SEQ ID NO. 518, CDR-L2 as depicted in SEQ ID NO. 519 and CDR-L3 as depicted in SEQ ID NO. 520; wherein preferred are (c) CDR-L1 as depicted in SEQ ID NO. 56, CDR-L2 as depicted in SEQ ID NO. 57 and CDR-L3 as depicted in SEQ ID NO. 58; (n) CDR-L1 as depicted in SEQ ID NO. 177, CDR-L2 as depicted in SEQ ID NO. 178 and CDR-L3 as depicted in SEQ ID NO. 179; (ac) CDR-L1 as depicted in SEQ ID NO. 342, CDR-L2 as depicted in SEQ ID NO. 343 and CDR-L3 as depicted in SEQ ID NO. 344; and (aj) CDR-L1 as depicted in SEQ ID NO. 419, CDR-L2 as depicted in SEQ ID NO. 420 and CDR-L3 as depicted in SEQ ID NO. 421.

Item 61. The method of treatment according to any one of items 35 to 60, wherein the drug is an antibody construct, wherein the first binding domain comprises a VL region and a VH region selected from the group consisting of: (a) a VL region as depicted in SEQ ID NO. 38 and a VH region as depicted in SEQ ID NO. 37; (b) a VL region as depicted in SEQ ID NO. 49 and a VH region as depicted in SEQ ID NO. 48; (c) a VL region as depicted in SEQ ID NO. 60 and a VH region as depicted in SEQ ID NO. 59; (d) a VL region as depicted in SEQ ID NO. 71 and a VH region as depicted in SEQ ID NO. 70; (e) a VL region as depicted in SEQ ID NO. 82 and a VH region as depicted in SEQ ID NO. 81; (f) a VL region as depicted in SEQ ID NO. 93 and a VH region as depicted in SEQ ID NO. 92; (g) a VL region as depicted in SEQ ID NO. 104 and a VH region as depicted in SEQ ID NO. 103; (h) a VL region as depicted in SEQ ID NO. 115 and a VH region as depicted in SEQ ID NO. 114; (i) a VL region as depicted in SEQ ID NO. 126 and a VH region as depicted in SEQ ID NO. 125; (j) a VL region as depicted in SEQ ID NO. 137 and a VH region as depicted in SEQ ID NO. 136; (k) a VL region as depicted in SEQ ID NO. 148 and a VH region as depicted in SEQ ID NO. 147; (1) a VL region as depicted in SEQ ID NO. 159 and a VH region as depicted in SEQ ID NO. 158; (m) a VL region as depicted in SEQ ID NO. 170 and a VH region as depicted in SEQ ID NO. 169; (n) a VL region as depicted in SEQ ID NO. 181 and a VH region as depicted in SEQ ID NO. 180; (o) a VL region as depicted in SEQ ID NO. 192 and a VH region as depicted in SEQ ID NO. 191; (p) a VL region as depicted in SEQ ID NO. 203 and a VH region as depicted in SEQ ID NO. 202; (q) a VL region as depicted in SEQ ID NO. 214 and a VH region as depicted in SEQ ID NO. 213; (r) a VL region as depicted in SEQ ID NO. 226 and a VH region as depicted in SEQ ID NO. 225; (s) a VL region as depicted in SEQ ID NO. 236 and a VH region as depicted in SEQ ID NO. 235; (t) a VL region as depicted in SEQ ID NO. 247 and a VH region as depicted in SEQ ID NO. 246; (u) a VL region as depicted in SEQ ID NO. 258 and a VH region as depicted in SEQ ID NO. 257; (v) a VL region as depicted in SEQ ID NO. 269 and a VH region as depicted in SEQ ID NO. 268; (w) a VL region as depicted in SEQ ID NO. 280 and a VH region as depicted in SEQ ID NO. 279; (x) a VL region as depicted in SEQ ID NO. 292 and a VH region as depicted in SEQ ID NO. 290; (y) a VL region as depicted in SEQ ID NO. 302 and a VH region as depicted in SEQ ID NO. 301; (z) a VL region as depicted in SEQ ID NO. 313 and a VH region as depicted in SEQ ID NO. 312; (aa) a VL region as depicted in SEQ ID NO. 324 and a VH region as depicted in SEQ ID NO. 323; (ab) a VL region as depicted in SEQ ID NO. 335 and a VH region as depicted in SEQ ID NO. 334; (ac) a VL region as depicted in SEQ ID NO. 346 and a VH region as depicted in SEQ ID NO. 345; (ad) a VL region as depicted in SEQ ID NO. 357 and a VH region as depicted in SEQ ID NO. 356; (ae) a VL region as depicted in SEQ ID NO. 368 and a VH region as depicted in SEQ ID NO. 367; (af) a VL region as depicted in SEQ ID NO. 379 and a VH region as depicted in SEQ ID NO. 378; (ag) a VL region as depicted in SEQ ID NO. 390 and a VH region as depicted in SEQ ID NO. 389; (ah) a VL region as depicted in SEQ ID NO. 401 and a VH region as depicted in SEQ ID NO. 400; (ai) a VL region as depicted in SEQ ID NO. 412 and a VH region as depicted in SEQ ID NO. 411; (aj) a VL region as depicted in SEQ ID NO. 423 and a VH region as depicted in SEQ ID NO. 422; (ak) a VL region as depicted in SEQ ID NO. 434 and a VH region as depicted in SEQ ID NO. 433; (al) a VL region as depicted in SEQ ID NO. 445 and a VH region as depicted in SEQ ID NO. 444; (am) a VL region as depicted in SEQ ID NO. 456 and a VH region as depicted in SEQ ID NO. 455; (an) a VL region as depicted in SEQ ID NO. 467 and a VH region as depicted in SEQ ID NO. 466; (ao) a VL region as depicted in SEQ ID NO. 478 and a VH region as depicted in SEQ ID NO. 477; (ap) a VL region as depicted in SEQ ID NO. 489 and a VH region as depicted in SEQ ID NO. 488; (aq) a VL region as depicted in SEQ ID NO. 500 and a VH region as depicted in SEQ ID NO. 499; (ar) a VL region as depicted in SEQ ID NO. 511 and a VH region as depicted in SEQ ID NO. 510; and (as) a VL region as depicted in SEQ ID NO. 522 and a VH region as depicted in SEQ ID NO. 521.

Item 62. The method of treatment according to any one of items 35 to 61, wherein the drug is an antibody construct, wherein the antibody construct comprises a sequence selected from an amino acid sequence as depicted in any of SEQ ID NOs: 39, 50, 61, 72, 83, 94, 105, 116, 127, 138, 149, 160, 171, 182, 193, 204, 215, 226, 237, 248, 259, 270, 281, 292, 303, 314, 325, 336, 347, 358, 369, 380, 391, 402, 413, 424, 435, 446, 457, 468, 479, 490, 501, 512, and 523.

Item 63. The method of treatment according to any one of items 35 to 62, wherein the drug is an antibody construct, wherein the antibody construct comprises in an amino to carboxyl order: (a) the first domain having an amino acid sequence selected from the group consisting of SEQ ID NOs: 39, 50, 61, 72, 83, 94, 105, 116, 127, 138, 149, 160, 171, 182, 193, 204, 215, 226, 237, 248, 259, 270, 281, 292, 303, 314, 325, 336, 347, 358, 369, 380, 391, 402, 413, 424, 435, 446, 457, 468, 479, 490, 501, 512, and 523; (b) a peptide linker having an amino acid sequence selected from the group consisting of SEQ ID NOs: 10-12; (c) the second domain having an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 or as depicted in SEQ ID NO: 13.

Item 64. The method of treatment according to any one of items 35 to 63, wherein the drug is an antibody construct, wherein the antibody construct further comprises in an amino to carboxyl order: (d) a peptide linker having an amino acid sequence selected from the group consisting of SEQ ID NOs: 10, 11, 12, 17, 18, 19 and 20; (e) the first polypeptide monomer of the third domain having a polypeptide sequence selected from the group consisting of SEQ ID NOs: 22-29; (f) a peptide linker having an amino acid sequence selected from the group consisting of SEQ ID NOs: 13, 14, 15 and 16; and (g) the second polypeptide monomer of the third domain having a polypeptide sequence selected from the group consisting of SEQ ID NOs: 22-29.

Item 65. The method of treatment according to any one of items 35 to 64, wherein the drug is an antibody construct having an amino acid sequence selected from the group consisting of: SEQ ID NOs: 40, 41, 51, 52, 62, 63, 73, 74, 84, 85, 95, 96, 106, 107, 117, 118, 128, 129, 139, 140, 150, 151, 161, 162, 172, 173, 183, 184, 194, 195, 205, 206, 216, 217, 227, 228, 238, 239, 249, 250, 260, 261, 271, 272, 282, 283, 293, 294, 304, 305, 315, 316, 326, 327, 337, 338, 348, 349, 359, 360, 370, 371, 381, 382, 392, 393, 403, 404, 414, 415, 424, 426, 436, 437, 447, 448, 458, 459, 469, 470, 480, 481, 491, 492, 502, 503, 513, 514, 524 and 525, or having an amino acid having at least 90, 91, 92, 93, 94, 95, 96, 97, 98 or 99% identity to said sequences.

The present invention further relates to methods of treatment as defined in the claims and as set forth below.

In a first aspect of the methods of treatment according to the present invention it is envisaged in to administer an antibody construct comprising a first domain which binds to MUC17, and a second domain which binds to an extracellular epitope of the human and the *Macaca* CD3ε chain. Within said aspect, it is further envisaged that the antibody construct comprises a third domain which comprises two polypeptide monomers, each comprising a hinge, a CH2 domain and a CH3 domain, wherein said two polypeptide monomers are fused to each other via a peptide linker. Within said aspect, it is further envisaged that the antibody construct is a single chain antibody construct. Within said aspect, it is also envisaged that the antibody construct has a third domain comprising in an amino to carboxyl order: hinge-CH2-CH3-linker-hinge-CH2-CH3. Within said aspect, it is further envisaged that each of said polypeptide monomers has an amino acid sequence that is at least 90% identical to a sequence as defined in the sequence listing and the respective claims. Within said aspect, it is further envisaged to administer an antibody construct, wherein the CH2 domain comprises an intra domain cysteine disulfide bridge. Within said aspect, it is also envisaged that an antibody construct is administered, wherein (i) the first domain comprises two antibody variable domains and the second domain comprises two antibody variable domains; (ii) the first domain comprises one antibody variable domain and the second domain comprises two antibody variable domains; (iii) the first domain comprises two antibody variable domains and the second domain comprises one antibody variable domain; or (iv) the first domain comprises one antibody variable domain and the second domain comprises one antibody variable domain Within said aspect, it is also envisaged that an antibody construct is administered, wherein the first and second domain are fused to the third domain via a peptide linker. In this respect, it is particularly contemplated that the antibody construct is an antibody construct as disclosed in WO 2019/133961, which is hereby incorporated by reference. The antibody constructs as claimed in said disclosure may be used in the herein described methods of treatment. It is further envisaged in the context of the present invention to administer a pharmaceutical composition comprising an antibody construct as defined above.

The methods of treatment according to the invention comprise the prevention, alleviation, prevention of worsening or recurrence, or amelioration of a disease selected from a proliferative disease, a tumorous disease, cancer as defined in the claims, e.g., gastrointestinal cancer (such as gastric cancer, esophageal cancer, gastroesophageal (junction) cancer or colorectal cancer) or pancreatic cancer, comprising the step of administering to a subject in need thereof a antibody construct directed against MUC17 and CD3. In the context of the present invention, administration of an antibody construct targeting specifically MUC17 associated with a malignancy diagnosis is provided. To this end, first MUC17 is identified as a gene that is upregulated in gastric tumors relative to normal tissue expression. In this regard, it is shown that the MUC17 protein is expressed in 40-77% of gastric tumors according to the herein described inventive immunohistochemistry methods. It is also demonstrated by flow cytometry that MUC17 protein is expressed on the cell surface of gastric cancer cell lines and esophageal cancer cell lines, in addition to some pancreatic cancer cell lines and colorectal cancer cell lines. It has even been shown that such expression is specifically high in gastric tumors in Chinese patients. Hence, MUC17 is identified as a valid target associated with gastrointestinal cancer, i.e. cancer of the stomach, small intestine and large intestine (colon), esophageal cancer and pancreatic cancer. In the context of the present invention, the antibody constructs administered exhibit binding affinity, potent cytotoxic activity, and are the most stable map to the SEA domain. The administered antibody constructs may have a cysteine clamp, i.e. intramolecular disulfide bond, in the target binder for improved stability, and may also be in a single chain Fc(scFc) format as half-life extended (HLE) moiety and directed against MUC17. Further, the scFc, i.e. HLE, antibody construct enables intravenous dosing with administration only once every week, once every two weeks, once every three weeks or even once every four weeks, or less frequently. Thus, the antibody constructs used in the methods of the invention comprise a first domain which binds to MUC17, a second domain which binds to an extracellular epitope of the human and the *Macaca* CD3ε chain; and optionally a third domain which comprises two polypeptide monomers, each comprising a hinge, a CH2 domain and a CH3 domain, wherein said two polypeptide monomers are fused to each other via a peptide linker. In an embodiment, the administered antibody construct comprises all three such domains.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen and/or is/are drawn from the variable heavy chain (VH) and/or variable light chain (VL) domains of an antibody or fragment thereof. Furthermore, the domain which binds to its binding partner is understood herein as a binding domain of an antibody construct. Typically, a binding domain according to the present invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. An alternative approach to define the minimal structure requirements of an antibody is the definition of the epitope of the antibody within the structure of the specific target, respectively, the protein domain of the target protein composing the epitope region (epitope cluster) or by reference to a specific antibody competing with the epitope of the defined antibody. The antibodies on which the constructs according to the invention are based include for example monoclonal, recombinant, chimeric, deimmunized, humanized and human antibodies. The binding domain of an antibody construct administered according to the invention may e.g. comprise the above referred groups of CDRs. Preferably, those CDRs are comprised in the framework of an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a $F(ab')_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Also within the definition of "binding domain" or "domain which binds" are fragments of full-length antibodies, such as VH, VHH, VL, (s)dAb, Fv, Fd, Fab, Fab', F(ab')2 or "r IgG" ("half antibody"). Antibody constructs administered according to the invention may also comprise modified fragments of antibodies, also called antibody variants, such as scFv, di-scFv or bi(s)-scFv, scFv-Fc, scFv-zipper, scFab, $Fab_2$, $Fab_3$, diabodies, single chain diabodies, tandem diabodies (Tandab's), tandem di-scFv, tandem tri-scFv, "multibodies" such as triabodies or tetrabodies, and single domain antibodies such as nanobodies or single variable domain antibodies comprising merely one variable domain, which may be VHH, VH or VL, that specifically bind an antigen or epitope independently of other V regions or domains. As used herein, the terms "single-chain Fv," "single-chain antibodies" or "scFv" refer to single polypeptide chain antibody fragments that comprise the variable regions from both the heavy and light chains, but lack the constant regions. Generally, a single-chain antibody further comprises a polypeptide linker between the VH and VL domains which enables it to form the desired structure which would allow for antigen binding. Single chain antibodies are discussed in detail by Pluckthun in The Pharmacology of Monoclonal Antibodies, vol. 113, Rosenburg and Moore eds. Springer-Verlag, New York, pp. 269-315 (1994). Various methods of generating single chain antibodies are known, including those described in U.S. Pat. Nos. 4,694,778 and 5,260,203; International Patent Application Publication No. WO 88/01649; Bird (1988) Science 242:423-442; Huston et al. (1988) Proc. Natl. Acad. Sci. USA 85:5879-5883; Ward et al. (1989) Nature 334:54454; Skerra et al. (1988) Science 242:1038-1041. In specific embodiments, single-chain antibodies can also be bispecific, multispecific, human, and/or humanized and/or synthetic.

Furthermore, the definition of the term "antibody construct" includes monovalent, bivalent and polyvalent/multivalent constructs and, thus, bispecific constructs, specifically binding to only two antigenic structure, as well as polyspecific/multispecific constructs, which specifically bind more than two antigenic structures, e.g. three, four or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The term "bispecific" as used herein refers to an antibody construct which is "at least bispecific", i.e., it comprises at least a first binding domain and a second binding domain, wherein the first binding domain binds to one antigen or target (here: MUC17), and the second binding domain binds to another antigen or target (here: CD3). Accordingly, antibody constructs according to the invention comprise specificities for at least two different antigens or targets. For example, the first domain does preferably not bind to an extracellular epitope of CD3ε of one or more of the species as described herein. The term "target cell surface antigen" refers to an antigenic structure expressed by a cell and which is present at the cell surface such that it is accessible for an antibody construct as described herein. It may be a protein, preferably the extracellular portion of a protein, or a carbohydrate structure, preferably a carbohydrate structure of a protein, such as a glycoprotein. It is preferably a tumor antigen. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs administered according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sides with different specificities. Bispecific antibody constructs can be produced by a variety of methods including fusion of hybridomas or linking of Fab' fragments. See, e.g., Songsivilai & Lachmann, Clin. Exp. Immunol. 79:315-321 (1990). The at least two binding domains and the variable domains (VH/VL) of the antibody construct may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. The peptide linkers can also be used to fuse the third domain to the other domains of the antibody construct. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct.

The antibody constructs are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic side or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method. For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S.

Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96). Hybridomas can then be screened using standard methods, such as enzyme-linked immunosorbent assay (ELISA) and surface plasmon resonance analysis, e.g. Biacore™ to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the Biacore system can be used to increase the efficiency of phage antibodies which bind to an epitope of a target cell surface antigen (Schier, Human Antibodies Hybridomas 7 (1996), 97-105; Malmborg, J. Immunol. Methods 183 (1995), 7-13). Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetic diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sides (e. g. 6-7 sides) are mutated to generate all possible amino acid substitutions at each side. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sides for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human MUC17. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs administered in accordance with the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816, 567; Morrison et al., Proc. Natl. Acad. Sci. USA, 81: 6851-6855 (1984)). Chimeric antibodies of interest include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992). Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector. Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen. A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or side-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse. Preferably, a "fully human antibody" does not include amino acid residues not encoded by human germline immunoglobulin sequences.

The antibody constructs administered according to the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g. constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes a domain which (specifically) binds to/interacts with/recognizes a given target epitope or a given target side on the target molecules (antigens), here: MUC17 and CD3, respectively. The structure and function of the first binding domain (recognizing MUC17), and preferably also the structure and/or function of the second binding domain (recognizing CD3), is/are based on the structure and/or function of an antibody, e.g. of a full-length or whole immunoglobulin molecule, and/or is/are drawn from the variable heavy chain (VH) and/or variable light chain (VL) domains of an antibody or fragment thereof. Preferably the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids).

The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a heteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to MUC17 and/or the binding domain which binds to CD3ε is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in yeast artificial chromosomes YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations. One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XenoMouse mouse strains (see Green et al. Nature Genetics 7:13-21 (1994)). The XenoMouse strains were engineered with YACs containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions may recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620. The production of the XenoMouse animals is further discussed and delineated in U.S. patent application Ser. Nos. 07/466,008, 07/610,515, 07/919,297, 07/922,649, 08/031,801, 08/112,848, 08/234,145, 08/376,279, 08/430,938, 08/464,584, 08/464,582, 08/463,191, 08/462,837, 08/486,853, 08/486,857, 08/486,859, 08/462,513, Ser. No. 08/724,752, and 08/759,620; and U.S. Pat. Nos. 6,162,963; 6,150,584; 6,114,598; 6,075,181, and 5,939,598 and Japanese Patent Nos. 3068180B2, 3068506B2, and 3068507B2. See also Mendez et al. Nature Genetics 15:146-156 (1997) and Green and Jakobovits J. Exp. Med. 188:483-495 (1998), EP0463151B1, WO 94/02602, WO 96/34096, WO 98/24893, WO 00/76310, and WO 03/47336.

In another approach, others, including GenPharm International, Inc., utilized a "minilocus" approach. In the minilocus approach, an exogenous Ig locus is mimicked through the inclusion of individual genes from the Ig locus. Thus, one/more VH genes, one/more DH genes, one/more JH genes, a mu constant region, and a second constant region (preferably a gamma constant region) are formed into constructs for insertion into animals. This approach is described in U.S. Pat. No. 5,545,807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721,367; and 5,789,215 to Berns et al., and U.S. Pat. No. 5,643,763 to Choi and Dunn, and GenPharm International U.S. patent application Ser. Nos. 07/574,748, 07/575,962, 07/810,279, 07/853,408, 07/904,068, 07/990,860, 08/053,131, 08/096,762, 08/155,301, 08/161,739, 08/165,699, 08/209,741. See EP0546073B1, WO92/03918, WO92/22645, WO92/22647, WO92/22670, WO93/12227, WO94/00569, WO94/25585, WO96/14436, WO97/13852, and WO98/24884 and U.S. Pat. No. 5,981,175. See also Taylor et al. (1992) and (1994), Chen et al. (1993), Tuaillon et al. (1993) and (1995), Choi et al. (1993), Lonberg et al. (1994), and Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against MUC17 and a human binding domain against CD3ε in order to vitiate concerns and/or effects of HAMA or HACA response.

The terms "(selectively) binds to", "(specifically) binds to", (specifically) recognizes", "is (specifically) directed to", and "(specifically) reacts with" mean in accordance with this invention that a binding domain interacts or specifically interacts with a given epitope or a given target side on the target molecules (antigens), here: MUC17 and CD3ε, respectively.

The term "epitope" refers to a side on an antigen to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction side". Said binding/interaction is also understood to define a "specific recognition". "Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence. A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically, a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for one of the binding domains is comprised within the target cell surface antigen protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy. A method for epitope mapping is described in the following: When a region (a contiguous amino acid stretch) in the human MUC17 protein is exchanged or replaced with its corresponding region of a non-human and non-primate MUC17 (e.g., mouse MUC17, but others like chicken, rat, hamster, rabbit etc. may also be conceivable), a decrease in the binding of the binding domain is expected to occur, unless the binding domain is cross-reactive for the non-human, non-primate MUC17 used. Said decrease is preferably at least 10%, 20%, 30%, 40%, or 50%; more preferably at least 60%, 70%, or 80%, and most preferably 90%, 95% or even 100% in comparison to the binding to the respective region in the human MUC17 protein, whereby binding to the respective region in the human MUC17 protein is set to be 100%. It is envisaged that the aforementioned human MUC17/non-human MUC17 chimeras are expressed in CHO cells. It is also envisaged that the human MUC17/non-human MUC17 chimeras are fused with a transmembrane domain and/or cytoplasmic domain of a different membrane-bound protein such as EpCAM.

In an alternative or additional method for epitope mapping, several truncated versions of the human MUC17 extracellular domain can be generated in order to determine a specific region that is recognized by a binding domain. In these truncated versions, the different extracellular MUC17 domains/sub-domains or regions are stepwise deleted, starting from the N-terminus. It is envisaged that the truncated MUC17 versions may be expressed in CHO cells. It is also envisaged that the truncated MUC17 versions may be fused with a transmembrane domain and/or cytoplasmic domain of a different membrane-bound protein such as EpCAM. It is also envisaged that the truncated MUC17 versions may encompass a signal peptide domain at their N-terminus, for example a signal peptide derived from mouse IgG heavy chain signal peptide. It is furthermore envisaged that the truncated MUC17 versions may encompass a v5 domain at their N-terminus (following the signal peptide) which allows verifying their correct expression on the cell surface. A decrease or a loss of binding is expected to occur with those truncated MUC17 versions which do not encompass any more the MUC17 region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human MUC17 protein (or its extracellular region or domain) is set to be 100.

A further method to determine the contribution of a specific residue of MUC17 to the recognition by an antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: MUC17 and CD3, respectively) and, generally, does not exhibit significant reactivity with proteins or antigens other than the MUC17 or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than the MUC17 or CD3. Preferably, a binding domain of the invention does not essentially or substantially bind to proteins or antigens other than MUC17 or CD3 (i.e., the first binding domain is not capable of binding to proteins other than MUC17 and the second binding domain is not capable of binding to proteins other than CD3). It is an envisaged characteristic of the antibody constructs according to the present invention to have superior affinity characteristics in comparison to other HLE formats. Such a superior affinity, in consequence, suggests a prolonged half-life in vivo. The longer half-life of the antibody constructs according to the present invention may reduce the duration and frequency of administration which typically contributes to improved patient compliance. This is of particular importance as the antibody constructs of the present invention are particularly beneficial for highly weakened or even multimorbid cancer patients.

The term "does not essentially/substantially bind" or "is not capable of binding" means that a binding domain of the present invention does not bind a protein or antigen other than the MUC17 or CD3, i.e., does not show reactivity of more than 30%, preferably not more than 20%, more preferably not more than 10%, particularly preferably not more than 9%, 8%, 7%, 6% or 5% with proteins or antigens other than MUC17 or CD3, whereby binding to the MUC17 or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-side with its specific antigen may result in a simple binding of said side to the antigen. Moreover, the specific interaction of the antigen-interaction-side with its specific antigen may alternatively or additionally result in the initiation of a signal, e.g. due to the induction of a change of the conformation of the antigen, an oligomerization of the antigen, etc.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site. Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three-dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding side (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity. The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding side is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred. Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three-dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding side. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant ("C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "Fc portion" or "Fc monomer" means in connection with this invention a polypeptide comprising at least one domain having the function of a CH2 domain and at least one domain having the function of a CH3 domain of an immunoglobulin molecule. As apparent from the term "Fc monomer", the polypeptide comprising those CH domains is a "polypeptide monomer". An Fc monomer can be a polypeptide comprising at least a fragment of the constant region of an immunoglobulin excluding the first constant region immunoglobulin domain of the heavy chain (CH1), but maintaining at least a functional part of one CH2 domain and a functional part of one CH3 domain, wherein the CH2 domain is amino terminal to the CH3 domain. In a preferred aspect of this definition, an Fc monomer can be a polypeptide constant region comprising a portion of the Ig-Fc hinge region, a CH2 region and a CH3 region, wherein the hinge region is amino terminal to the CH2 domain. It is envisaged that the hinge region of the present invention promotes dimerization. Such Fc polypeptide molecules can be obtained by papain digestion of an immunoglobulin region (of course resulting in a dimer of two Fc polypeptide), for example and not limitation. In another aspect of this definition, an Fc monomer can be a polypeptide region comprising a portion of a CH2 region and a CH3 region. Such Fc polypeptide molecules can be obtained by pepsin digestion of an immunoglobulin molecule, for example and not limitation. In one embodiment, the polypeptide sequence of an Fc monomer is substantially similar to an Fc polypeptide sequence of: an $IgG_1$ Fc region, an $IgG_2$ Fc region, an $IgG_3$ Fc region, an $IgG_4$ Fc region, an IgM Fc region, an IgA Fc region, an IgD Fc region and an IgE Fc region. (See, e.g., Padlan, Molecular Immunology, 31(3), 169-217 (1993)). Because there is some variation between immunoglobulins, and solely for clarity, Fc monomer refers to the last two heavy chain constant region immunoglobulin domains of IgA, IgD, and IgG, and the last three heavy chain constant region immunoglobulin domains of IgE and IgM.

As mentioned, the Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion may vary an example for a human IgG heavy chain Fc portion comprising a functional hinge, CH2 and CH3 domain can be defined e.g. to comprise residues D231 (of the hinge domain—corresponding to D234 in Table 2 below) to P476, respectively L476 (for $IgG_4$) of the carboxyl-terminus of the CH3 domain, wherein the numbering is according to Kabat. The two Fc portion or Fc monomer, which are fused to each other via a peptide linker define the third domain of the antibody construct of the invention, which may also be defined as scFc domain. It is envisaged that a scFc domain as disclosed herein, respectively the Fc monomers fused to each other are comprised only in the third domain of the antibody construct.

TABLE 2

Kabat numbering of the amino acid residues of the hinge region

| IMGT numbering for the hinge | $IgG_1$ amino acid translation | Kabat numbering |
|---|---|---|
| 1 | (E) | 226 |
| 2 | P | 227 |
| 3 | K | 228 |
| 4 | S | 232 |
| 5 | C | 233 |
| 6 | D | 234 |
| 7 | K | 235 |
| 8 | T | 236 |
| 9 | H | 237 |
| 10 | T | 238 |
| 11 | C | 239 |
| 12 | P | 240 |
| 13 | P | 241 |
| 14 | C | 242 |
| 15 | P | 243 |

The location and sequence of the IgG CH2 and IgG CD3 domain can be identified by analogy using the Kabat numbering as set forth in Table 3:

TABLE 3

Kabat numbering of the amino acid residues of the IgG CH2 and CH3 region

| IgG sub-type | CH2 aa translation | CH2 Kabat numbering | CH3 aa translation | CH3 Kabat numbering |
|---|---|---|---|---|
| $IgG_1$ | APE . . . KAK | 244 . . . 360 | GQP . . . PGK | 361 . . . 478 |
| $IgG_2$ | APE . . . KTK | 244 . . . 360 | GQP . . . PGK | 361 . . . 478 |
| $IgG_3$ | APE . . . KTK | 244 . . . 360 | GQP . . . PGK | 361 . . . 478 |
| $IgG_4$ | APE . . . KAK | 244 . . . 360 | GQP . . . LGK | 361 . . . 478 |

In one embodiment of the invention the emphasized bold amino acid residues in the CH3 domain of the first or both Fc monomers are deleted.

The peptide linker, by whom the polypeptide monomers ("Fc portion" or "Fc monomer") of the third domain are fused to each other, preferably comprises at least 25 amino acid residues (25, 26, 27, 28, 29, 30 etc.). More preferably, this peptide linker comprises at least 30 amino acid residues (30, 31, 32, 33, 34, 35 etc.). It is also preferred that the linker comprises up to 40 amino acid residues, more preferably up to 35 amino acid residues, most preferably exactly 30 amino acid residues.

In the event that a linker is used to fuse the first domain to the second domain, or the first or second domain to the third domain, this linker is preferably of a length and sequence sufficient to ensure that each of the first and second domains can, independently from one another, retain their differential binding specificities. For peptide linkers which connect the at least two binding domains (or two variable domains) in the antibody construct, those peptide linkers are preferred which comprise only a few amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A preferred embodiment of the peptide linker for a fusion the first and the second domain is depicted in SEQ ID NO:10. A preferred linker embodiment of the peptide linker for fusing the second and the third domain is a $(Gly)_4$-linker, also called $G_4$-linker. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

According to a particularly preferred embodiment, the first and the second domain of the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain antibody constructs are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also "divalent") or bispecific single-chain variable fragments (bi-scFvs or di-scFvs having the format $(scFv)_2$ can be engineered by linking two scFv molecules (e.g. with linkers as described hereinbefore). If these two scFv molecules have the same binding specificity, the resulting $(scFv)_2$ molecule will preferably be called bivalent (i.e. it has two valences for the same target epitope). If the two scFv molecules have different binding specificities, the resulting $(scFv)_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) PNAS 90 (14): 6444-8).

Either the first, the second or the first and the second domain may comprise a single domain antibody, respectively the variable domain or at least the CDRs of a single domain antibody. Single domain antibodies comprise merely one (monomeric) antibody variable domain which is able to bind selectively to a specific antigen, independently of other V regions or domains. The first single domain antibodies were engineered from heavy chain antibodies found in camelids, and these are called $V_HH$ fragments. Cartilaginous fishes also have heavy chain antibodies (IgNAR) from which single domain antibodies called $V_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies. A (single domain $mAb)_2$ is hence a monoclonal antibody construct composed of (at least) two single domain monoclonal antibodies, which are individually selected from the group comprising $V_H$, $V_L$, $V_HH$ and $V_{NAR}$ The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Possible means for the read-out includes flow cytometry.

Cytotoxicity mediated by antibody constructs can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque MUC17 which is bound by the first domain, the effector cells should also be of macaque origin such as a macaque T cell line, e.g. 4119LnPx. The target cells should express (at least the extracellular domain of) MUC17, e.g. human or macaque MUC17. Target cells can be a cell line (such as CHO) which is stably or transiently transfected with MUC17, e.g. human or macaque MUC17. Usually $EC_{50}$ values are expected to be lower with target cell lines expressing higher levels of MUC17 on the cell surface. The effector to target cell (E:T) ratio is usually about 10:1, but can also vary. Cytotoxic activity of MUC17 bispecific antibody constructs can be measured in a $^{51}Cr$-release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by MUC17×CD3 antibody constructs is preferably measured in a cell-based cytotoxicity assay. It may also be measured in a $^{51}Cr$-release assay. It is represented by the $EC_{50}$ value, which corresponds to the half maximal effective concentration (concentration of the antibody construct which induces a cytotoxic response halfway between the baseline and maximum). Preferably, the $EC_{50}$ value of the MUC17×CD3 antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably ≤5 pM. Preferably, the MUC17×CD3 antibody constructs do not induce/mediate lysis or do not essentially induce/mediate lysis of MUC17 negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of MUC17 negative cells, whereby lysis of a MUC17 positive human cell line is set to be 100%. This usually applies for concentrations of the antibody construct of up to 500 nM. The skilled person knows how to measure cell lysis without further ado.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human MUC17 and human CD3, respectively, will also bind to MUC17/CD3 of primates including (but not limited to) new world primates (such as *Callithrix jacchus, Saguinus Oedipus* or *Saimiri sciureus*), old world primates (such baboons and macaques), gibbons, and non-human homininae.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions. The compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods. In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

- amino acids such as glycine, alanine, glutamine, asparagine, threonine, proline, 2-phenylalanine, including charged amino acids, preferably lysine, lysine acetate, arginine, glutamate and/or histidine
- antimicrobials such as antibacterial and antifungal agents
- antioxidants such as ascorbic acid, methionine, sodium sulfite or sodium hydrogen-sulfite;
- buffers, buffer systems and buffering agents which are used to maintain the composition at physiological pH or at a slightly lower pH, preferably a lower pH of 4.0 to 6.5; examples of buffers are borate, bicarbonate, Tris-HCl, citrates, phosphates or other organic acids, succinate, phosphate, and histidine; for example Tris buffer of about pH 7.0-8.5;
- non-aqueous solvents such as propylene glycol, polyethylene glycol, vegetable oils such as olive oil, and injectable organic esters such as ethyl oleate;
- aqueous carriers including water, alcoholic/aqueous solutions, emulsions or suspensions, including saline and buffered media;
- biodegradable polymers such as polyesters;
- bulking agents such as mannitol or glycine;
- chelating agents such as ethylenediamine tetraacetic acid (EDTA);
- isotonic and absorption delaying agents;
- complexing agents such as caffeine, polyvinylpyrrolidone, beta-cyclodextrin or hydroxypropyl-beta-cyclodextrin) fillers;
- monosaccharides; disaccharides; and other carbohydrates (such as glucose, mannose or dextrins); carbohydrates may be non-reducing sugars, preferably trehalose, sucrose, octasulfate, sorbitol or xylitol;
- (low molecular weight) proteins, polypeptides or proteinaceous carriers such as human or bovine serum albumin, gelatin or immunoglobulins, preferably of human origin;
- coloring and flavouring agents;
- sulfur containing reducing agents, such as glutathione, thioctic acid, sodium thioglycolate, thioglycerol, [alpha]-monothioglycerol, and sodium thio sulfate
- diluting agents;
- emulsifying agents;
- hydrophilic polymers such as polyvinylpyrrolidone)
- salt-forming counter-ions such as sodium;
- preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);
- metal complexes such as Zn-protein complexes;
- solvents and co-solvents (such as glycerin, propylene glycol or polyethylene glycol);
- sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;
- suspending agents;
- surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;
- stability enhancing agents such as sucrose or sorbitol;
- tonicity enhancing agents such as alkali metal halides, preferably sodium or potassium chloride, mannitol sorbitol;
- parenteral delivery vehicles including sodium chloride solution, Ringer's dextrose, dextrose and sodium chloride, lactated Ringer's, or fixed oils;
- intravenous delivery vehicles including fluid and nutrient replenishers, electrolyte replenishers (such as those based on Ringer's dextrose).

It is envisaged that the composition may comprise, in addition to the antibody construct defined herein, further biologically active agents, depending on the intended use of the composition. Such agents may be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament. In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations, especially as to protein pharmaceutical products and processes for veterinary and/or human medical uses.

Salts may be used in accordance with certain embodiments to, for example, adjust the ionic strength and/or the isotonicity of a formulation and/or to improve the solubility and/or physical stability of a protein or other ingredient of a composition. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility. Ionic species differ significantly in their effects on proteins. A number of categorical rankings of ions and their effects on proteins have been developed that can be used in formulating pharmaceutical compositions. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct formulations in accordance with various embodiments as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols. In addition, sugars that form such reactive species, such as sucrose, which is hydrolyzed to fructose and glucose under acidic conditions, and consequently engenders glycation, also is not among preferred polyols. PEG is useful to stabilize proteins and as a cryoprotectant and can be used in this regard.

Embodiments of the antibody construct formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct formulations further comprise one or more antioxidants. To some extent deleterious oxidation of proteins can be prevented in pharmaceutical formulations by maintaining proper levels of ambient oxygen and temperature and by avoiding exposure to light.

Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants are selected to, among other things, eliminate or sufficiently reduce the possibility of themselves damaging proteins in the formulation.

Formulations may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+2}$ ions.

Embodiments of the formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized-dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As may be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above. It is an envisaged characteristic of the antibody constructs of the present invention provided with the specific FC modality that they comprise, for example, differences in pharmacokinetic behavior. A half-life extended targeting antibody construct according to the present invention preferably shows a surprisingly increased residence time in vivo in comparison to "canonical" non-HLE versions of said antibody construct. "Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

In a preferred aspect the pharmaceutical composition is stable for at least four weeks at about −20° C. As apparent from the appended examples the quality of an antibody construct of the invention vs. the quality of corresponding state of the art antibody constructs may be tested using different systems. Those tests are understood to be in line with the "ICH Harmonised Tripartite Guideline: Stability Testing of Biotechnological/Biological Products Q5C and Specifications: Test procedures and Acceptance Criteria for Biotech Biotechnological/Biological Products Q6B" and, thus are elected to provide a stability-indicating profile that provides certainty that changes in the identity, purity and potency of the product are detected. It is well accepted that the term purity is a relative term. Due to the effect of glycosylation, deamidation, or other heterogeneities, the absolute purity of a biotechnological/biological product should be typically assessed by more than one method and the purity value derived is method-dependent. For the purpose of stability testing, tests for purity should focus on methods for determination of degradation products.

For the assessment of the quality of a pharmaceutical composition comprising an antibody construct of the invention may be analyzed e.g. by analyzing the content of soluble aggregates in a solution (HMWS per size exclusion). It is preferred that stability for at least four weeks at about −20° C. is characterized by a content of less than 1.5% HMWS, preferably by less than 1% HMWS.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a disease as specified herein below, by the administration of an antibody construct to a subject in need thereof. Such an improvement may also be seen as a slowing or stopping of the progression of the patient's disease. The term "prevention" as used herein means the avoidance of the occurrence or re-occurrence of a patient having a tumor or cancer or a metastatic cancer as specified herein below, by the administration of an antibody construct to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metatstatic cancer" encompasses metastases to other tissues or organs than the one of the original tumor. Lymphomas and leukemias are lymphoid neoplasms. For the purposes of the present invention, they are also encompassed by the terms "tumor" or "cancer".

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. The routes of administration include, but are not limited to

- topical routes (such as epicutaneous, inhalational, nasal, opthalmic, auricular/aural, vaginal, mucosal);
- enteral routes (such as oral, gastrointestinal, sublingual, sublabial, buccal, rectal); and
- parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447,233; 4,486,194; 4,487,603; 4,596,556; 4,790,824; 4,941,880; 5,064,413; 5,312,335; 5,312,335; 5,383,851; and 5,399,163.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect. A typical dosage may range from about 0.1 μg/kg to up to about 30 mg/kg or more, depending on the factors mentioned above. In specific embodiments, the dosage may range from 1.0 μg/kg up to about 20 mg/kg, optionally from 10 μg/kg up to about 10 mg/kg or from 100 μg/kg up to about 5 mg/kg. A therapeutic effective amount of an antibody construct preferably results in a decrease in severity of disease symptoms, an increase in frequency or duration of disease symptom-free periods or a prevention of impairment or disability due to the disease affliction. For treating diseases correlating with MUC17 expression as described herein above, a therapeutically effective amount of the antibody construct of the invention, here: an anti-MUC17/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct as defined herein or separately before or after administration of said antibody construct in timely defined intervals and doses.

The term "effective and non-toxic dose" as used herein refers to a tolerable dose of an antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT). The term "toxicity" as used herein refers to the toxic effects of a drug manifested in adverse events or severe adverse events. These side events may refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Finally, the invention provides a diagnostic kit comprising an antibody of the invention or produced according to the process of the invention.

In the context of the present invention, the term "kit" means two or more components—one of which corresponding to the antibody construct of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

As used herein, the singular forms "a", "an", and "the" include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range. It also includes the concrete value, e.g., "about 50" includes the value "50".

Throughout this specification and the claims, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein, any of the terms "comprising", "consisting essentially of" and "consisting of" may be replaced with either of the other two terms.

The above description and the below examples provide exemplary arrangements, but the present invention is not limited to the specific methodologies, techniques, protocols, material, reagents, substances, etc., described herein and as such can vary. The terminology used herein is for describing particular embodiments only and is not intended to limit the scope of the present invention, which is defined solely by the claims. Aspects of the invention are provided in the independent claims. Some optional features of the invention are provided in the dependent claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

A better understanding of the present invention and of its advantages will be obtained from the following examples, offered for illustrative purposes only. The examples are not intended and should not be construed as to limit the scope of the present invention in any way.

Sequences:

| SEQ ID NO: | Description | Sequence |
|---|---|---|
| 1 | Human MUC17 amino acid sequence UniProt entry Q685J3) | MPRPGTMALCLLTLVLSLLPPQAAAEQDLSVNRAVWDGGGCISQGDVL<br>NRQCQQLSQHVRTGSAANTATGTTSTNVVEPRMYLSCSTNPEMTSIES<br>SVTSDTPGVSSTRMTPTESRTTSESTSDSTTLFPSSTEDTSSPTTPEG<br>TDVPMSTPSEESISSTMAFVSTAPLPSFEAYTSLTYKVDMSTPLTTST<br>QASSSPTTPESTTIPKSTNSEGSTPLTSMPASTMKVASSEAITLLTTP<br>VEISTPVTISAQASSSPTTAEGPSLSNSAPSGGSTPLTRMPLSVMLVV<br>SSEASTLSTTPAATNIPVITSTEASSSPTTAEGTSIPTSTYTEGSTPL<br>TSTPASTMPVATSEMSTLSITPVDTSTLVTTSTEPSSLPTTAEATSML<br>TSTLSEGSTPLTNMPVSTILVASSEASTTSTIPVDSKTFVTTASEASS<br>SPTTAEDTSIATSTPSEGSTPLTSMPVSTTPVASSEASNLSTTPVDSK<br>TQVTTSTEASSSPPTAEVNSMPTSTPSEGSTPLTSMSVSTMPVASSEA<br>STLSTTPVDTSTPVTTSSEASSSSTTPEGTSIPTSTPSEGSTPLTNMP<br>VSTRLVVSSEASTTSTTPADSNTFVTTSSEASSSSTTAEGTSMPTSTY<br>SERGTTITSMSVSTTLVASSEASTLSTTPVDSNTPVTTSTEATSSSTT<br>AEGTSMPTSTYTEGSTPLTSMPVNTTLVASSEASTLSTTPVDTSTPVT<br>TSTEASSSPTTADGASMPTSTPSEGSTPLTSMPVSKTLLTSSEASTLS<br>TTPLDTSTHITTSTEASCSPTTTEGTSMPISTPSEGSPLLTSIPVSIT<br>PVTSPEASTLSTTPVDSNSPVTTSTEVSSSPTPAEGTSMPTSTYSEGR<br>TPLTSMPVSTTLVATSAISTLSTTPVDTSTPVTNSTEARSSPTTSEGT<br>SMPTSTPGEGSTPLTSMPDSTTPVVSSEARTLSATPVDTSTPVTTSTE<br>ATSSPTTAEGTSIPTSTPSEGTTPLTSTPVSHTLVANSEASTLSTTPV<br>DSNTPLTTSTEASSPPPTAEGTSMPTSTPSEGSTPLTRMPVSTTMVAS<br>SETSTLSTTPADTSTPVTTYSQASSSSTTADGTSMPTSTYSEGSTPLT<br>SVPVSTRLVVSSEASTLSTTPVDTSIPVTTSTEASSSPTTAEGTSIPT<br>SPPSEGTTPLASMPVSTTLVVSSEANTLSTTPVDSKTQVATSTEASSP<br>PPTAEVTSMPTSTPGERSTPLTSMPVRHTPVASSEASTLSTSPVDTST<br>PVTTSAETSSSPTTAEGTSLPTSTTSEGSTLLTSIPVSTTLVTSPEAS<br>TLLTTPVDTKGPVVTSNEVSSSPTPAEGTSMPTSTYSEGRTPLTSIPV<br>NTTLVASSAISILSTTPVDNSTPVTTSTEACSSPTTSEGTSMPNSNPS<br>EGTTPLTSIPVSTTPVVSSEASTLSATPVDTSTPGTTSAEATSSPTTA<br>EGISIPTSTPSEGKTPLKSIPVSNTPVANSEASTLSTTPVDSNSPVVT<br>STAVSSSPTPAEGTSIAISTPSEGSTALTSIPVSTTTVASSEINSLST<br>TPAVTSTPVTTYSQASSSPTTADGTSMQTSTYSEGSTPLTSLPVSTML<br>VVSSEANTLSTTPIDSKTQVTASTEASSSTTAEGSSMTISTPSEGSPL<br>LTSIPVSTTPVASPEASTLSTTPVDSNSPVITSTEVSSSPTPAEGTSM<br>PTSTYTEGRTPLTSITVRTTPVASSAISTLSTTPVDNSTPVTTSTEAR<br>SSPTTSEGTSMPNSTPSEGTTPLTSIPVSTTPVLSSEASTLSATPIDT<br>STPVTTSTEATSSPTTAEGTSIPTSTLSEGMTPLTSTPVSHTLVANSE<br>ASTLSTTPVDSNSPVVTSTAVSSSPTPAEGTSIATSTPSEGSTALTSI<br>PVSTTTVASSETNTLSTTPAVTSTPVTTYAQVSSSPTTADGSSMPTST |

-continued

| SEQ ID NO: | Description | Sequence |
|---|---|---|
| | | PREGRPPLTSIPVSTTTVASSEINTLSTTLADTRTPVTTYSQASSSPT<br>TADGTSMPTPAYSEGSTPLTSMPLSTTLVVSSEASTLSTTPVDTSTPA<br>TTSTEGSSSPTTAGGTSIQTSTPSERTTPLAGMPVSTTLVVSSEGNTL<br>STTPVDSKTQVTNSTEASSSATAEGSSMTPSAPSEGSPLLTSIPLSTT<br>PVASPEASTLSTTPVDSNSPVITSTEVSSSPIPTEGTSMQTSTYSDRR<br>TPLTSMPVSTTVVASSAISTLSTTPVDTSTPVTNSTEARSSPTTSEGT<br>SMPTSTPSEGSTPFTSMPVSTMPVVTSEASTLSATPVDTSTPVTTSTE<br>atsspttaegtsiptstlsegttpltsipvshtlvansevstlsttpv<br>DSNTPFTTSTEASSPPPTAEGTSMPTSTSSEGNTPLTRMPVSTTMVAS<br>FETSTLSTTPADTSTPVTTYSQAGSSPTTADDTSMPTSTYSEGSTPLT<br>SVPVSTMPVVSSEASTHSTTPVDTSTPVTTSTEASSSPTTAEGTSIPT<br>SPPSEGTTPLASMPVSTTPVVSSEAGTLSTTPVDTSTPMTTSTEASSS<br>PTTAEDIVVPISTASEGSTLLTSIPVSTTPVASPEASTLSTTPVDSNS<br>PVVTSTEISSSATSAEGTSMPTSTYSEGSTPLRSMPVSTKPLASSEAS<br>TLSTTPVDTSIPVTTSTETSSSPTTAKDTSMPISTPSEVSTSLTSILV<br>STMPVASSEASTLSTTPVDTRTLVTTSTGTSSSPTTAEGSSMPTSTPG<br>ERSTPLTNILVSTTLLANSEASTLSTTPVDTSTPVTTSAEASSSPTTA<br>EGTSMRISTPSDGSTPLTSILVSTLPVASSEASTVSTTAVDTSIPVTT<br>STEASSSPTTAEVTSMPTSTPSETSTPLTSMPVNHTPVASSEAGTLST<br>TPVDTSTPVTTSTKASSSPTTAEGIVVPISTASEGSTLLTSIPVSTTP<br>VASSEASTLSTTPVDTSIPVTTSTEGSSSPTTAEGTSMPISTPSEVST<br>PLTSILVSTVPVAGSEASTLSTTPVDTRTPVTTSAEASSSPTTAEGTS<br>MPISTPGERRTPLTSMSVSTMPVASSEASTLSRTPADTSTPVTTSTEA<br>SSSPTTAEGTGIPISTPSEGSTPLTSIPVSTTPVAIPEASTLSTTPVD<br>SNSPVVTSTEVSSSPTPAEGTSMPISTYSEGSTPLTGVPVSTTPVTSS<br>AISTLSTTPVDTSTPVTTSTEAHSSPTTSEGTSMPTSTPSEGSTPLTY<br>MPVSTMLVVSSEDSTLSATPVDTSTPVTTSTEATSSTTAEGTSIPTST<br>PSEGMTPLTSVPVSNTPVASSEASILSTTPVDSNTPLTTSTEASSSPP<br>TAEGTSMPTSTPSEGSTPLTSMPVSTTTVASSETSTLSTTPADTSTPV<br>TTYSQASSSPPIADGTSMPTSTYSEGSTPLTNMSFSTTPVVSSEASTL<br>STTPVDTSTPVTTSTEASLSPTTAEGTSIPTSSPSEGTTPLASMPVST<br>TPVVSSEVNTLSTTPVDSNTLVTTSTEASSSPTIAEGTSLPTSTTSEG<br>STPLSIMPLSTTPVASSEASTLSTTPVDTSTPVTTSSPTNSSPTTAEV<br>TSMPTSTAGEGSTPLTNMPVSTTPVASSEASTLSTTPVDSNTFVTSSS<br>QASSSPATLQVTTMRMSTPSEGSSSLTTMLLSSTYVTSSEASTPSTPS<br>VDRSTPVTTSTQSNSTPTPPEVITLPMSTPSEVSTPLTIMPVSTTSVT<br>ISEAGTASTLPVDTSTPVITSTQVSSSPVTPEGTTMPIWTPSEGSTPL<br>TTMPVSTTRVTSSEGSTLSTPSVVTSTPVTTSTEAISSSATLDSTTMS<br>VSMPMEISTLGTTILVSTTPVTRFPESSTPSIPSVYTSMSMTTASEGS<br>SSPTTLEGTTTMPMSTTSERSTLLTTVLISPISVMSPSEASTLSTPPG<br>DTSTPLLTSTKAGSFSIPAEVTTIRISITSERSTPLTTLLVSTTLPTS<br>FPGASIASTPPLDTSTTFTPSTDTASTPTIPVATTISVSVITEGSTPG<br>TTIFIPSTPVTSSTADVFPATTGAVSTPVITSTELNTPSTSSSSTTTS<br>FSTTKEFTTPAMTTAAPLTYVTMSTAPSTPRTTSRGCTTSASTLSATS<br>TPHTSTSVTTRPVTPSSESSRPSTITSHTIPPTFPPAHSSTPPTTSAS<br>STTVNPEAVTTMTTRTKPSTRTTSFPTVTTTAVPTNTTIKSNPTSTPT<br>VPRTTTCFGDGCQNTASRCKNGGTWDGLKCQCPNLYYGELCEEVVSSI<br>DIGPPETISAQMELTVTVTSVKFTEELKNHSSQEFQEFKQTFTEQMNI<br>VYSGIPEYVGVNITKLRLGSVVVEHDVLLRTKYTPEYKTVLDNATEVV<br>KEKITKVTTQQIMINDICSDMMCFNTTGTQVQNITVTQYDPEEDCRKM<br>AKEYGDYFVVEYRDQKPYCISPCEPGFSVSKNCNLGKCQMSLSGPQCL<br>CVTTETHWYSGETCNQGTQKSLVYGLVGAGVVLMLIILVALLMLVFRS<br>KREVKRQKYRLSQLYKWQEEDSGPAPGTFQNIGFDICQDDDSIHLESI<br>YSNFQPSLRHIDPETKIRIQRPQVMTTSF |
| 2 | 4C11 antibody heavy chain CDR1 (artificial) | GNFLN |
| 3 | 4C11 antibody heavy chain CDR2 (artificial) | RITPYSGETFYNQKFKD |
| 4 | 4C11 antibody heavy chain CDR3 (artificial) | GVTTEVSHYYAMDY |
| 5 | Full HC sequence anti-huMUC17 4C11 IHC | MGWSWIFLFLLSVTAGVFSEVQLQQSGPELVKPGDSVKISCKASGYSF<br>TGNFLNWVMQSHGKSLEWIGRITPYSGETFYNQKFKDKATLTVDISSS<br>IAHMELRSLTSEDSAVYYCARGVTTEVSHYYAMDYWGQGTAVTVSSAK<br>TTAPSVYPLAPVCGDTTGSSVTLGCLVKGYFPEPVTLTWNSGSLSSGV<br>HTFPAVLQSDLYTLSSSVTVTSSTWPSQSITCNVAHPASSTKVDKKIE<br>PRGPTIKPCPPCKCPAPNLLGGPSVFIFPPKIKDVLMISLSPIVTCVV<br>VDVSEDDPDVQISWFVNNVEVHTAQTQTHREDYNSTLRVVSALPIQHQ<br>DWMSGKEFKCKVNNKDLPAPIERTISKPKGSVRAPQVYVLPPPEEEMT |

-continued

| SEQ ID NO: | Description | Sequence |
|---|---|---|
| | | KKQVTLTCMVTDFMPEDIYVEWTNNGKTELNYKNTEPVLDSDGSYFMY SKLRVEKKNWVERNSYSCSVVHEGLHNHHTTKSFSRTPGK |
| 6 | 4C11 antibody light chain CDR1 (artificial) | HASQNINLWLH |
| 7 | 4C11 antibody light chain CDR2 (artificial) | KASNLHT |
| 8 | 4C11 antibody light chain CDR3 (artificial) | QQGQSYPLT |
| 9 | Full LC sequence anti-huMUC17 4011 IHC | MRVLAELLGLLLFCFLGVRCDIQMNQSPSSLSASLGDTITITCHASQN INLWLHWYQQKPGNIPKLLIFKASNLHTGVPLRFSGSGSGTGFTLTIS SLQPEDIATYFCQQGQSYPLTFGGGTKLEIKRADAAPTVSIFPPSSEQ LTSGGASVVCFLNNFYPKDINVKWKIDGSERQNGVLNSWTDQDSKDST YSMSSTLTLTKDEYERHNSYTCEATHKTSTSPIVKSFNRNEC |
| 10 | G4S linker | GGGGS |
| 11 | (G4S)2 linker | GGGGSGGGGS |
| 12 | (G4S)3 linker | GGGGSGGGGSGGGGS |
| 13 | (G4S)5 linker | GGGGSGGGGSGGGGSGGGGSGGGGS |
| 14 | (G4S)6 linker | GGGGSGGGGSGGGGSGGGGSGGGGSGGGGS |
| 15 | (G4S)7 linker | GGGGSGGGGSGGGGSGGGGSGGGGSGGGGSGGGGS |
| 16 | (G4S)8 linker | GGGGSGGGGSGGGGSGGGGSGGGGSGGGGSGGGGSGGGGS |
| 17 | Peptide linker | PGGGGS |
| 18 | Peptide linker | PGGDGS |
| 19 | Peptide linker | SGGGGS |
| 20 | Peptide linker | GGGG |
| 21 | CD3ϵ binder scFv (artificial) | EVQLVESGGGLVQPGGSLRLSCAASGFTFNSYAMNWVRQAPGKGLEWV ARIRSKYNNYATYYADSVKGRFTISRDDSKNTAYLQMNSLKTEDTAVY YCVRHGNFGNSYVSWWAYWGQGTLVTVSSGGGGSGGGGSGGGGSQTVV TQEPSLTVSPGGTVTLTCGSSTGAVTSGNYPNWVQQKPGQAPRGLIGG TKFLAPGTPARFSGSLLGGKAALTLSGVQPEDEAEYYCVLWYSNRWVF GGGTKLTVL |
| 22 | Fc monomer-1+c/-g | DKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSPGK |
| 23 | Fc monomer-2+c/-g/ delGK | DKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSP |
| 24 | Fc monomer-3-c/+g | DKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSPGK |
| 25 | Fc monomer-4-c/+g/delGK | DKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSP |

-continued

| SEQ ID NO: | Description | Sequence |
|---|---|---|
| 26 | Fc monomer-5-c/-g | DKTHTCPPCPAPELLGGPSVFLFPPKPKDTLMISRTPEVTCVVVDVSH EDPEVKFNWYVDGVEVHNAKTKPREEQYGSTYRVVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSPGK |
| 27 | Fc monomer-6-c/-g/delGK | DKTHTCPPCPAPELLGGPSVFLFPPKPKDTLMISRTPEVTCVVVDVSH EDPEVKFNWYVDGVEVHNAKTKPREEQYGSTYRVVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSP |
| 28 | Fc monomer-7+c/+g | DKTHTCPPCPAPELLGGPSVFLFPPKPKDTLMISRTPEVTCVVVDVSH EDPEVKFNWYVDGVEVHNAKTKPCEEQYNSTYRCVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSPGK |
| 29 | Fc monomer-8+c/+g/delGK | DKTHTCPPCPAPELLGGPSVFLFPPKPKDTLMISRTPEVTCVVVDVSH EDPEVKFNWYVDGVEVHNAKTKPCEEQYNSTYRCVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSP |
| 30 | scFc-1 | DKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNG KEYKCKVSNKALPAPIEKTISKAKGQPREPQVYTLPPSREEMTKNQVS LTCLVKGFYPSDIAVEWESNGQPENNYKTTPPVLDSDGSFFLYSKLTV DKSRWQQGNVFSCSVMHEALHNHYTQKSLSLSPGKGGGGSGGGGSGGG GSGGGGSGGGGSGGGGSDKTHTCPPCPAPELLGGPSVFLFPPKPKDTL MISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQ VYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSL SPGK |
| 31. | MU 92-G6 CC × I2C0-SCFc VH CDR1 | SYGMH |
| 32. | MU 92-G6 CC × I2C0-SCFc VH CDR2 | VISFEGSNKYYASSVKG |
| 33. | MU 92-G6 CC × I2C0-SCFc VH CDR3 | GAYTYGFDY |
| 34. | MU 92-G6 CC × I2C0-SCFc VL CDR1 | RASQSVNRYLA |
| 35. | MU 92-G6 CC × I2C0-SCFc VL CDR2 | GASNRAT |
| 36. | MU 92-G6 CC × I2C0-SCFc VL CDR3 | HHYGSSIFA |
| 37. | MU 92-G6 CC × I2C0-SCFc VH | QVQLVESGGGVVQPGRSLRLSCAASGFTFSSYGMHWVRQAPGKCLEWV AVISFEGSNKYYASSVKGRFTISRDNSKNTLYLQMNSLRAEDTAVYYC ARGAYTYGFDYWGQGTLVTVSS |
| 38. | MU 92-G6 CC × I2C0-SCFc VL | EIVLTQSPGTLSLSPGERATLSCRASQSVNRYLAWYQQKPGQAPRLLIY GASNRATGIPDRFTGSGSGTDFTLTISRLEPEDFAVYFCHHYGSSIFAF GCGTKVEIK |
| 39. | MU 92-G6 CC × I2C0-scFc scFv | QVQLVESGGGVVQPGRSLRLSCAASGFTFSSYGMHWVRQAPGKCLEWV AVISFEGSNKYYASSVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK |
| 40. | MU 92-G6 CC × I2C0-scFc Bispecific molecule | QVQLVESGGGVVQPGRSLRLSCAASGFTFSSYGMHWVRQAPGKCLEWV AVISFEGSNKYYASSVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG |

-continued

| SEQ ID NO: | Description | Sequence |
|---|---|---|
| | | KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 41. | MU 92-G6 CC × I2C0-scFc Bispecific HLE molecule | QVQLVESGGGVVQPGRSLRLSCAASGFTFSSYGMHWVRQAPGKCLEWV AVISFEGSNKYYASSVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 42. | MU 92-C12 CC × I2C0-scFc VH CDR1 | SFGMH |
| 43. | MU 92-C12 CC × I2C0-scFc VH CDR2 | VIWFSGSNKYYAEAVKG |
| 44. | MU 92-C12 CC × I2C0~scFc VH CDR3 | GGYTYGFDY |
| 45. | MU 92-C12 CC × I2C0~scFc VL CDR1 | RANQAINRYLA |
| 46. | MU 92-C12 CC × I2C0~scFc VL CDR2 | GASSRAT |
| 47. | MU 92-C12 CC × I2C0~scFc VL CDR3 | HHYGSSIFT |
| 48. | MU 92-C12 CC × I2C0-scFc VH | QVQLVESGGGVVQPGRSLRLSCAASGFTFSSFGMHWVRQAPGKCLEWV AVIWFSGSNKYYAEAVKGRFTISRDNSKNTLYLQMNNLRAEDTAVYYC ARGGYTYGFDYWGQGTLVTVSS |
| 49. | MU 92-C12 CC × I2C0-scFc VL | EIVLTQSPATLSLSPGERATLSCRANQAINRYLAWYQQKPGQAPRLLI YGASSRATGIPDRFSGSGSGTDFTLTISRLEPEDFAVYYCHHYGSSIF TFGCGTKVEIK |
| 50. | MU 92-C12 CC × I2C0-scFc scFv | QVQLVESGGGVVQPGRSLRLSCAASGFTFSSFGMHWVRQAPGKCLEWV AVIWFSGSNKYYAEAVKGRFTISRDNSKNTLYLQMNNLRAEDTAVYYC ARGGYTYGFDYWGQGTLVTVSSGGGGSGGGGSGGGGSEIVLTQSPATL SLSPGERATLSCRANQAINRYLAWYQQKPGQAPRLLIYGASSRATGIP DRFSGSGSGTDFTLTISRLEPEDFAVYYCHHYGSSIFTFGCGTKVEIK |
| 51. | MU 92-C12 CC × I2C0-scFc Bispecific molecule | QVQLVESGGGVVQPGRSLRLSCAASGFTFSSFGMHWVRQAPGKCLEWV AVIWFSGSNKYYAEAVKGRFTISRDNSKNTLYLQMNNLRAEDTAVYYC ARGGYTYGFDYWGQGTLVTVSSGGGGSGGGGSGGGGSEIVLTQSPATL SLSPGERATLSCRANQAINRYLAWYQQKPGQAPRLLIYGASSRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |

-continued

| SEQ ID NO: | Description | Sequence |
|---|---|---|
| 52. | MU 92-C12 CC × I2C0-scFc Bispecific HLE molecule | QVQLVESGGGVVQPGRSLRLSCAASGFTFSSFGMHWVRQAPGKCLEWV AVIWFSGSNKYYAEAVKGRFTISRDNSKNTLYLQMNNLRAEDTAVYYC ARGGYTYGFDYWGQGTLVTVSSGGGGSGGGGSGGGGSEIVLTQSPATL SLSPGERATLSCRANQAINRYLAWYQQKPGQAPRLLIYGASSRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 53. | MU 32-G6 CC × I2C0-SCFc VH CDR1 | NHAMH |
| 54. | MU 32-G6 CC × I2C0-SCFc VH CDR2 | GIWSEGSNKYYAESVKG |
| 55. | MU 32-G6 CC × I2C0-SCFc VH CDR3 | ATYTTGWSYFDY |
| 56. | MU 32-G6 CC × I2C0-SCFc VL CDR1 | SGDKLGDKYAS |
| 57. | MU 32-G6 CC × I2C0-SCFc VL CDR2 | QDRKRPS |
| 58. | MU 32-G6 CC × I2C0-SCFc VL CDR3 | QAYDASTWV |
| 59. | MU 32-G6 CC × I2C0-SCFc VH | QVQLVESGGGVVQPGRSLRLSCAASGFTFSNHAMHWVRQAPGKCLEWV AGIWSEGSNKYYAESVKGRFTISRDNSKNTLYLQMNSLRAEDTAVYYC ARATYTTGWSYFDYWGQGTLVTVSS |
| 60. | MU 32-G6 CC × I2C0-SCFc VL | SYELTQPPSVSVSPGQTASITCSGDKLGDKYASWYQQKSGQSPVLVIY QDRKRPSGIPERFSGSNSGNTATLTISGTQAMDEADYYCQAYDASTWV FGCGTQLTVL |
| 61. | MU 32-G6 CC × I2C0-scFc scFv | QVQLVESGGGVVQPGRSLRLSCAASGFTFSNHAMHWVRQAPGKCLEWV AGIWSEGSNKYYAESVKGRFTISRDNSKNTLYLQMNSLRAEDTAVYYC ARATYTTGWSYFDYWGQGTLVTVSSGGGGSGGGGSGGGGSSYELTQPP SVSVSPGQTASITCSGDKLGDKYASWYQQKSGQSPVLVIYQDRKRPSG IPERFSGSNSGNTATLTISGTQAMDEADYYCQAYDASTWVFGCGTQLT VL |
| 62. | MU 32-G6 CC × I2C0-scFc Bispecific molecule | QVQLVESGGGVVQPGRSLRLSCAASGFTFSNHAMHWVRQAPGKCLEWV AGIWSEGSNKYYAESVKGRFTISRDNSKNTLYLQMNSLRAEDTAVYYC ARATYTTGWSYFDYWGQGTLVTVSSGGGGSGGGGSGGGGSSYELTQPP SVSVSPGQTASITCSGDKLGDKYASWYQQKSGQSPVLVIYQDRKRPSG IPERFSGSNSGNTATLTISGTQAMDEADYYCQAYDASTWVFGCGTQLT VLSGGGGSEVQLVESGGGLVQPGGSLKLSCAASGFTFNKYAMNWVRQA PGKGLEWVARIRSKYNNYATYYADSVKDRFTISRDDSKNTAYLQMNNL KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVL |
| 63. | MU 32-G6 CC × I2C0-scFc Bispecific HLE molecule | QVQLVESGGGVVQPGRSLRLSCAASGFTFSNHAMHWVRQAPGKCLEWV AGIWSEGSNKYYAESVKGRFTISRDNSKNTLYLQMNSLRAEDTAVYYC ARATYTTGWSYFDYWGQGTLVTVSSGGGGSGGGGSGGGGSSYELTQPP SVSVSPGQTASITCSGDKLGDKYASWYQQKSGQSPVLVIYQDRKRPSG IPERFSGSNSGNTATLTISGTQAMDEADYYCQAYDASTWVFGCGTQLT VLSGGGGSEVQLVESGGGLVQPGGSLKLSCAASGFTFNKYAMNWVRQA PGKGLEWVARIRSKYNNYATYYADSVKDRFTISRDDSKNTAYLQMNNL |

-continued

| SEQ ID NO: | Description | Sequence |
|---|---|---|
| | | KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVLGGGGDKTHTCPPCPAPELLGGPSVFLFPPKP KDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQP REPQVYTLPPSREEMTKNQVSLTCLVKGFYPSDIAVEWESNGQPENNY kttppvldsdgsfflyskltvdksrwqqgnvfscsvmhealhnhytqk SLSLSPGKGGGGSGGGGSGGGGSGGGGSGGGGSGGGGSDKTHTCPPCP APELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNK ALPAPIEKTISKAKGQPREPQVYTLPPSREEMTKNQVSLTCLVKGFYP SDIAVEWESNGQPENNYKTTPPVLDSDGSFFLYSKLTVDKSRWQQGNV FSCSVMHEALHNHYTQKSLSLSPGK |
| 64. | MU 9-C2 CC × I2C0-scFc VH CDR1 | NFGMH |
| 65. | MU 9-C2 CC × I2C0-scFc VH CDR2 | VIWFDASKTYYASSVKG |
| 66. | MU 9-C2 CC × I2C0-scFc VH CDR3 | ATYSTGWSYFDY |
| 67. | MU 9-C2 CC × I2C0-scFc VL CDR1 | SGDKLGDKYTS |
| 68. | MU 9-C2 CC × I2C0-scFc VL CDR2 | HDAKRPS |
| 69. | MU 9-C2 CC × I2C0-scFc VL CDR3 | QAWDASTAWV |
| 70. | MU 9-C2 CC × I2C0-scFc VH | QVQLVESGGGVVQPGRSLRLSCAASGFTFSNFGMHWVRQAPGKCLEWV AVIWFDASKTYYASSVKGRFTISRDTSMNTLYLQMNSLRAEDTAVYYC ARATYSTGWSYFDYWGQGTLVTVSS |
| 71. | MU 9-C2 CC × I2C0-scFc VL | SYELTQPPSVSVSPGQTASITCSGDKLGDKYTSWYQQKPGQSPVLVIY HDAKRPSGIPERFSGSNSGNTATLTISGTQAMDEADYYCQAWDASTAW VFGCGTKLTVL |
| 72. | MU 9-C2 CC × I2C0-scFc scFv | QVQLVESGGGVVQPGRSLRLSCAASGFTFSNFGMHWVRQAPGKCLEWV AVIWFDASKTYYASSVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWDASTAWVFGCGTKL TVL |
| 73. | MU 9-C2 CC × I2C0-scFc Bispecific molecule | QVQLVESGGGVVQPGRSLRLSCAASGFTFSNFGMHWVRQAPGKCLEWV AVIWFDASKTYYASSVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWDASTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 74. | MU 9-C2 CC × I2C0-scFc Bispecific HLE molecule | QVQLVESGGGVVQPGRSLRLSCAASGFTFSNFGMHWVRQAPGKCLEWV AVIWFDASKTYYASSVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWDASTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVLGGGGDKTHTCPPCPAPELLGGPSVFLFPPK PKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPENN ykttppvldsdgsfflyskltvdksrwqqgnvfscsvmhealhnhytq |

-continued

| SEQ ID NO: | Description | Sequence |
|---|---|---|
| | | KSLSLSPGKGGGGSGGGGSGGGGSGGGGSGGGGSGGGGSDKTHTCPPC PAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSN KALPAPIEKTISKAKGQPREPQVYTLPPSREEMTKNQVSLTCLVKGFY PSDIAVEWESNGQPENNYKTTPPVLDSDGSFFLYSKLTVDKSRWQQGN VFSCSVMHEALHNHYTQKSLSLSPGK |
| 75. | MU 8-H9 CC × I2C0-SCFc VH CDR1 | GYYWS |
| 76. | MU 8-H9 CC × I2C0-SCFc VH CDR2 | DIEHSGSTKYNPSLKS |
| 77. | MU 8-H9 CC × I2C0-SCFc VH CDR3 | KKYSTVWSYFDY |
| 78. | MU 8-H9 CC × I2C0-SCFc VL CDR1 | SGDKLGDKYAS |
| 79. | MU 8-H9 CC × I2C0-SCFc VL CDR2 | HDNKRPS |
| 80. | MU 8-H9 CC × I2C0-SCFc VL CDR3 | QAYGSSSAV |
| 81. | MU 8-H9 CC × I2C0-SCFc VH | QVQLQQWGAGLLKPSETLSLTCAVYGGSFSGYYWSWIRQPPGKCLEWI GDIEHSGSTKYNPSLKSRVTISLDTSKNQFSLKLNSVTAADTAVYFCA RKKYSTVWSYFDYWGQGTLVTVSS |
| 82. | MU 8-H9 CC × I2C0-SCFc VL | SYELTQSPSASVSPGQTASITCSGDKLGDKYASWYQQKPGQSPVLVIY HDNKRPSGIPERFSGSNSGNTATLTISGTQAMDEADYYCQAYGSSSAV FGCGTKLTVL |
| 83. | MU 8-H9 CC × I2C0-scFc scFv | QVQLQQWGAGLLKPSETLSLTCAVYGGSFSGYYWSWIRQPPGKCLEWI GDIEHSGSTKYNPSLKSRVTISLDTSKNQFSLKLNSVTAADTAVYFCA RKKYSTVWSYFDYWGQGTLVTVSSGGGGSGGGGSGGGGSSYELTQSPS ASVSPGQTASITCSGDKLGDKYASWYQQKPGQSPVLVIYHDNKRPSGI PERFSGSNSGNTATLTISGTQAMDEADYYCQAYGSSSAVFGCGTKLTV L |
| 84. | MU 8-H9 CC × I2C0-scFc Bispecific molecule | QVQLQQWGAGLLKPSETLSLTCAVYGGSFSGYYWSWIRQPPGKCLEWI GDIEHSGSTKYNPSLKSRVTISLDTSKNQFSLKLNSVTAADTAVYFCA RKKYSTVWSYFDYWGQGTLVTVSSGGGGSGGGGSGGGGSSYELTQSPS ASVSPGQTASITCSGDKLGDKYASWYQQKPGQSPVLVIYHDNKRPSGI PERFSGSNSGNTATLTISGTQAMDEADYYCQAYGSSSAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 85. | MU 8-H9 CC × I2C0-scFc Bispecific HLE molecule | QVQLQQWGAGLLKPSETLSLTCAVYGGSFSGYYWSWIRQPPGKCLEWI GDIEHSGSTKYNPSLKSRVTISLDTSKNQFSLKLNSVTAADTAVYFCA RKKYSTVWSYFDYWGQGTLVTVSSGGGGSGGGGSGGGGSSYELTQSPS ASVSPGQTASITCSGDKLGDKYASWYQQKPGQSPVLVIYHDNKRPSGI PERFSGSNSGNTATLTISGTQAMDEADYYCQAYGSSSAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |

-continued

| SEQ ID NO: | Description | Sequence |
|---|---|---|
| 86. | MU 8-H8 CC × I2C0-SCFc VH CDR1 | GYYWS |
| 87. | MU 8-H8 CC × I2C0-SCFc VH CDR2 | DIDASGSTKYNPSLKS |
| 88. | MU 8-H8 CC × I2C0-SCFc VH CDR3 | KKYSTVWSYFDY |
| 89. | MU 8-H8 CC × I2C0-SCFc VL CDR1 | SGDKLGDKYAS |
| 90. | MU 8-H8 CC × I2C0-SCFc VL CDR2 | QDRKRPS |
| 91. | MU 8-H8 CC × I2C0-SCFc VL CDR3 | QAWGSSTAV |
| 92. | MU 8-H8 CC × I2C0-SCFc VH | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWGQGTLVTVSS |
| 93. | MU 8-H8 CC × I2C0-SCFc VL | SYELTQPPSVSVPPGQTASITCSGDKLGDKYASWYQQKPGQSPVLIIY QDRKRPSGVPERFSGSNSGNTATLTISGTQAMDEADYYCQAWGSSTAV FGCGTKLTVL |
| 94. | MU 8-H8 CC × I2C0-scFc scFv | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWGQGTLVTVSSGGGGSGGGGSGGGGSSYELTQPPS VSVPPGQTASITCSGDKLGDKYASWYQQKPGQSPVLIIYQDRKRPSGV PERFSGSNSGNTATLTISGTQAMDEADYYCQAWGSSTAVFGCGTKLTV L |
| 95. | MU 8-H8 CC × I2C0-scFc Bispecific molecule | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWGQGTLVTVSSGGGGSGGGGSGGGGSSYELTQPPS VSVPPGQTASITCSGDKLGDKYASWYQQKPGQSPVLIIYQDRKRPSGV PERFSGSNSGNTATLTISGTQAMDEADYYCQAWGSSTAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 96. | MU 8-H8 CC × I2C0-scFc Bispecific HLE molecule | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWGQGTLVTVSSGGGGSGGGGSGGGGSSYELTQPPS VSVPPGQTASITCSGDKLGDKYASWYQQKPGQSPVLIIYQDRKRPSGV PERFSGSNSGNTATLTISGTQAMDEADYYCQAWGSSTAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |
| 97. | MU 8-H5 CC × I2C0-SCFc VH CDR1 | SFGMH |
| 98. | MU 8-H5 CC × I2C0-SCFc VH CDR2 | VIWFDASNKYYAESVKG |

-continued

| SEQ ID NO: | Description | Sequence |
|---|---|---|
| 99. | MU 8-H5 CC × I2C0-SCFc VH CDR3 | GGYTYGFDY |
| 100. | MU 8-H5 CC × I2C0-SCFc VL CDR1 | RASQAVNRYLA |
| 101. | MU 8-H5 CC × I2C0-SCFc VL CDR2 | GASSRAT |
| 102. | MU 8-H5 CC × I2C0-SCFc VL CDR3 | QQYGSSIFT |
| 103. | MU 8-H5 CC × I2C0-SCFc VH | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSS |
| 104. | MU 8-H5 CC × I2C0-SCFc VL | EIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK |
| 105. | MU 8-H5 CC × I2C0-scFc scFv | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK |
| 106. | MU 8-H5 CC × I2C0-scFc Bispecific molecule | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 107. | MU 8-H5 CC × I2C0-scFc Bispecific HLE molecule | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 108. | MU 8-F11 CC × I2C0-SCFc VH CDR1 | SHYWS |
| 109. | MU 8-F11 CC × I2C0-SCFc VH CDR2 | RIDVSGSANYNPALKS |
| 110. | MU 8-F11 CC × I2C0-SCFc VH CDR3 | APYSSGWGYFDY |
| ill | MU 8-F11 CC × I2C0-SCFc VL CDR1 | SGDKLGDKYAS |
| 112. | MU 8-F11 CC × I2C0-SCFc VL CDR2 | HDNKRPS |

-continued

| SEQ ID NO: | Description | Sequence |
|---|---|---|
| 113. | MU 8-F11 CC × I2C0-SCFc VL CDR3 | QAWDITTAV |
| 114. | MU 8-F11 CC × I2C0-SCFc VH | QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSS |
| 115. | MU 8-F11 CC × I2C0-SCFc VL | SYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVL |
| 116. | MU 8-F11 CC × I2C0-scFc scFv | QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVL |
| 117. | MU 8-F11 CC × I2C0-scFc Bispecific molecule | QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 118. | MU 8-F11 CC × I2C0-scFc Bispecific HLE molecule | QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 119. | MU 8-F9 CC × I2C0-scFc VH CDR1 | GYYWS |
| 120. | MU 8-F9 CC × I2C0-SCFc VH CDR2 | DIDASGSTKYNPSLKS |
| 121. | MU 8-F9 CC × I2C0-scFc VH CDR3 | KKYSTVWSYFDY |
| 122. | MU 8-F9 CC × I2C0-scFc VL CDR1 | SGDKLGDKYAS |
| 123. | MU 8-F9 CC × I2C0-scFc VL CDR2 | QDRKRPS |
| 124. | MU 8-F9 CC × I2C0-scFc VL CDR3 | QAWGSSAAV |
| 125. | MU 8-F9 CC × I2C0-scFc VH | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSS |

-continued

| SEQ ID NO: | Description | Sequence |
|---|---|---|
| 126. | MU 8-F9 CC × I2C0-scFc VL | SYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVL |
| 127. | MU 8-F9 CC × I2C0-scFc scFv | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVL |
| 128. | MU 8-F9 CC × I2C0-scFc Bispecific molecule | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 129. | MU 8-F9 CC × I2C0-scFc Bispecific HLE molecule | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 130. | MU 8-E3 CC × I2C0-scFc VH CDR1 | NHGMH |
| 131. | MU 8-E3 CC × I2C0-scFc VH CDR2 | GIWSDASNKYYADAVKG |
| 132. | MU 8-E3 CC × I2C0-scFc VH CDR3 | ATYTTGWSYFDY |
| 133. | MU 8-E3 CC × I2C0-scFc VL CDR1 | SGDKLGDKYAS |
| 134. | MU 8-E3 CC × I2C0-scFc VL CDR2 | QDNKRPS |
| 135. | MU 8-E3 CC × I2C0-scFc VL CDR3 | QAYDASTWV |
| 136. | MU 8-E3 CC × I2C0-scFc VH | QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSS |
| 137. | MU 8-E3 CC × I2C0-scFc VL | SYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVL |
| 138. | MU 8-E3 CC × I2C0-scFc scFv | QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPA |

-continued

| SEQ ID NO: | Description | Sequence |
|---|---|---|
| | | SVSVSPGQTASITCSGDKLGDKYASWYQQKSGQSPVLVIYQDNKRPSG IPERFSGSNSGNTATLTISGTQAMDEADYYCQAYDASTWVFGCGTQLT VL |
| 139. | MU 8-E3 CC × I2C0-scFc Bispecific molecule | QVQLVESGGGVVQPGRSLRLACAASGFTFSNHGMHWVRQAPGKCLEWV AGIWSDASNKYYADAVKGRFTISRDNSKNTLYLQMNSLRAEDTAVYYC ARATYTTGWSYFDYWGQGTLVTVSSGGGGSGGGGSGGGGSSYELTQPA SVSVSPGQTASITCSGDKLGDKYASWYQQKSGQSPVLVIYQDNKRPSG IPERFSGSNSGNTATLTISGTQAMDEADYYCQAYDASTWVFGCGTQLT VLSGGGGSEVQLVESGGGLVQPGGSLKLSCAASGFTFNKYAMNWVRQA PGKGLEWVARIRSKYNNYATYYADSVKDRFTISRDDSKNTAYLQMNNL KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVL |
| 140. | MU 8-E3 CC × I2C0-scFc Bispecific HLE molecule | QVQLVESGGGVVQPGRSLRLACAASGFTFSNHGMHWVRQAPGKCLEWV AGIWSDASNKYYADAVKGRFTISRDNSKNTLYLQMNSLRAEDTAVYYC ARATYTTGWSYFDYWGQGTLVTVSSGGGGSGGGGSGGGGSSYELTQPA SVSVSPGQTASITCSGDKLGDKYASWYQQKSGQSPVLVIYQDNKRPSG IPERFSGSNSGNTATLTISGTQAMDEADYYCQAYDASTWVFGCGTQLT VLSGGGGSEVQLVESGGGLVQPGGSLKLSCAASGFTFNKYAMNWVRQA PGKGLEWVARIRSKYNNYATYYADSVKDRFTISRDDSKNTAYLQMNNL KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVLGGGGDKTHTCPPCPAPELLGGPSVFLFPPKP KDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQP REPQVYTLPPSREEMTKNQVSLTCLVKGFYPSDIAVEWESNGQPENNY kttppvldsdgsfflyskltvdksrwqqgnvfscsvmhealhnhytqk SLSLSPGKGGGGSGGGGSGGGGSGGGGSGGGGSGGGGSDKTHTCPPCP APELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNK ALPAPIEKTISKAKGQPREPQVYTLPPSREEMTKNQVSLTCLVKGFYP SDIAVEWESNGQPENNYKTTPPVLDSDGSFFLYSKLTVDKSRWQQGNV FSCSVMHEALHNHYTQKSLSLSPGK |
| 141. | MU 8-D7 CC × I2C0-scFc VH CDR1 | GYYWS |
| 142. | MU 8-D7 CC × I2C0-scFc VH CDR2 | DIDASGSTKYNPSLKS |
| 143. | MU 8-D7 CC × I2C0-scFc VH CDR3 | KKYSTVWSYFDY |
| 144. | MU 8-D7 CC × I2C0-scFc VL CDR1 | SGDKLGEKYAS |
| 145. | MU 8-D7 CC × I2C0-scFc VL CDR2 | QDRKRPS |
| 146. | MU 8-D7 CC × I2C0-scFc VL CDR3 | QAWGSSAAV |
| 147. | MU 8-D7 CC × I2C0-scFc VH | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWRQGTLVTVSS |
| 148. | MU 8-D7 CC × I2C0-scFc VL | SYELTQPSSVSVPPGQTASITCSGDKLGEKYASWYQQKPGQSPVLIIY QDRKRPSGVPERFSGSNSGNTATLTISGTQAMDEADYYCQAWGSSAAV FGCGTKLTVL |
| 149. | MU 8-D7 CC × I2C0-scFc scFv | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWRQGTLVTVSSGGGGSGGGGSGGGGSSYELTQPSS VSVPPGQTASITCSGDKLGEKYASWYQQKPGQSPVLIIYQDRKRPSGV PERFSGSNSGNTATLTISGTQAMDEADYYCQAWGSSAAVFGCGTKLTV LS |
| 150. | MU 8-D7 CC × I2C0-scFc Bispecific molecule | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWRQGTLVTVSSGGGGSGGGGSGGGGSSYELTQPSS VSVPPGQTASITCSGDKLGEKYASWYQQKPGQSPVLIIYQDRKRPSGV |

-continued

| SEQ ID NO: | Description | Sequence |
|---|---|---|
| | | PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 151. | MU 8-D7 CC × I2C0-scFc Bispecific HLE molecule | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDYWRQGTLVTVSSGGGGSGGGGSGGGGSSYELTQPSS VSVPPGQTASITCSGDKLGEKYASWYQQKPGQSPVLIIYQDRKRPSGV PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |
| 152. | MU 8-C7 CC × I2C0-scFc VH CDR1 | GYYWS |
| 153. | MU 8-C7 CC × I2C0-scFc VH CDR2 | DIDQSGSTKYNPSLKS |
| 154. | MU 8-C7 CC × I2C0-scFc VH CDR3 | KKYSTVWSYFDY |
| 155. | MU 8-C7 CC × I2C0-scFc VL CDR1 | SGDKLGDKYAS |
| 156. | MU 8-C7 CC × I2C0-scFc VL CDR2 | QDRKRPS |
| 157. | MU 8-C7 CC × I2C0-scFc VL CDR3 | QAWGSSAAV |
| 158. | MU 8-C7 CC × I2C0-scFc VH | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWRQGTLVTVSS |
| 159. | MU 8-C7 CC × I2C0-scFc VL | SYELTQPSSVSVSPGQTASITCSGDKLGDKYASWYQQKPGQSPVLIIY QDRKRPSGVPERFSGSNSGNTATLTISGTQAMDEADYYCQAWGSSAAV FGCGTKLTVL |
| 160. | MU 8-C7 CC × I2C0-scFc scFv | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWRQGTLVTVSSGGGGSGGGGSGGGGSSYELTQPSS VSVSPGQTASITCSGDKLGDKYASWYQQKPGQSPVLIIYQDRKRPSGV PERFSGSNSGNTATLTISGTQAMDEADYYCQAWGSSAAVFGCGTKLTV L |
| 161. | MU 8-C7 CC × I2C0-scFc Bispecific molecule | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWRQGTLVTVSSGGGGSGGGGSGGGGSSYELTQPSS VSVSPGQTASITCSGDKLGDKYASWYQQKPGQSPVLIIYQDRKRPSGV PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |

-continued

| SEQ ID NO: | Description | Sequence |
|---|---|---|
| 162. | MU 8-C7 CC × I2C0-scFc Bispecific HLE molecule | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 163. | MU 8-B8 CC × I2C0-scFc VH CDR1 | GYYWS |
| 164. | MU 8-B8 CC × I2C0-scFc VH CDR2 | DIDQSGSTKYNPSLKS |
| 165. | MU 8-B8 CC × I2C0-scFc VH CDR3 | KKYSTVWSYFDY |
| 166. | MU 8-B8 CC × I2C0-scFc VL CDR1 | SGDKLGDKYAS |
| 167. | MU 8-B8 CC × I2C0-scFc VL CDR2 | QDRKRPS |
| 168. | MU 8-B8 CC × I2C0-scFc VL CDR3 | QAWGSSAAV |
| 169. | MU 8-B8 CC × I2C0-scFc VH | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSS |
| 170. | MU 8-B8 CC × I2C0-scFc VL | SYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVL |
| 171. | MU 8-B8 CC × I2C0-scFc scFv | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVL |
| 172. | MU 8-B8 CC × I2C0-scFc Bispecific molecule | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 173. | MU 8-B8 CC × I2C0-scFc Bispecific HLE molecule | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGG |

-continued

| SEQ ID NO: | Description | Sequence |
|---|---|---|
| | | GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |
| 174. | MU 8-B7 CC × I2C0-scFc VH CDR1 | GYYWS |
| 175. | MU 8-B7 CC × I2C0-scFc VH CDR2 | DIDASGSTKYNPSLKS |
| 176. | MU 8-B7 CC × I2C0-scFc VH CDR3 | KKYSTVWSYFDN |
| 177. | MU 8-B7 CC × I2C0-scFc VL CDR1 | SGDKLGDKYAS |
| 178. | MU 8-B7 CC × I2C0-scFc VL CDR2 | QDRKRPS |
| 179. | MU 8-B7 CC × I2C0-scFc VL CDR3 | QAWGSSTAV |
| 180. | MU 8-B7 CC × I2C0-scFc VH | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDNWGQGTLVTVSS |
| 181. | MU 8-B7 CC × I2C0-scFc VL | SYELTQPSSVSVPPGQTASITCSGDKLGDKYASWYQQKPGQSPVLVIY QDRKRPSGVPERFSGSNSGNTATLTISGTQAMDEADYYCQAWGSSTAV FGCGTKLTVL |
| 182. | MU 8-B7 CC × I2C0-scFc scFv | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDNWGQGTLVTVSSGGGGSGGGGSGGGGSSYELTQPSS VSVPPGQTASITCSGDKLGDKYASWYQQKPGQSPVLVIYQDRKRPSGV PERFSGSNSGNTATLTISGTQAMDEADYYCQAWGSSTAVFGCGTKLTV L |
| 183. | MU 8-B7 CC × I2C0-scFc Bispecific molecule | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDNWGQGTLVTVSSGGGGSGGGGSGGGGSSYELTQPSS VSVPPGQTASITCSGDKLGDKYASWYQQKPGQSPVLVIYQDRKRPSGV PERFSGSNSGNTATLTISGTQAMDEADYYCQAWGSSTAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 184. | MU 8-B7 CC × I2C0-scFc Bispecific HLE molecule | QVQLQQWGAGLLKPSETLSLTCAVYGGSFSGYYWSWIRQPPGKCLEWI GDIDASGSTKYNPSLKSRVTISLDTSKNQFSLKLNSVTAADTAVYFCA RKKYSTVWSYFDNWGQGTLVTVSSGGGGSGGGGSGGGGSSYELTQPSS VSVPPGQTASITCSGDKLGDKYASWYQQKPGQSPVLVIYQDRKRPSGV PERFSGSNSGNTATLTISGTQAMDEADYYCQAWGSSTAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA |

-continued

| SEQ ID NO: | Description | Sequence |
|---|---|---|
| | | PELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 185. | MU 8-A7 CC × I2C0-scFc VH CDR1 | GYYWS |
| 186. | MU 8-A7 CC × I2C0-scFc VH CDR2 | DIDQSGSTKYNPSLKS |
| 187. | MU 8-A7 CC × I2C0-scFc VH CDR3 | KKYSTVWSYFDY |
| 188. | MU 8-A7 CC × I2C0-scFc VL CDR1 | SGDKLGDKYAS |
| 189. | MU 8-A7 CC × I2C0-scFc VL CDR2 | QDRKRPS |
| 190. | MU 8-A7 CC × I2C0-scFc VL CDR3 | QAWGSSTAV |
| 191. | MU 8-A7 CC × I2C0-scFc VH | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSS |
| 192. | MU 8-A7 CC × I2C0-SCFc VL | SYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL |
| 193. | MU 8-A7 CC × I2C0-scFc scFv | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL |
| 194. | MU 8-A7 CC × I2C0-scFc Bispecific molecule | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 195. | MU 8-A7 CC × I2C0-scFc Bispecific HLE molecule | QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

-continued

| SEQ ID NO: | Description | Sequence |
|---|---|---|
| 196. | MU 7-G6 CC × I2C0-scFc VH CDR1 | SYGMH |
| 197. | MU 7-G6 CC × I2C0-scFc VH CDR2 | VIWYSGSNKYYATSVKG |
| 198. | MU 7-G6 CC × I2C0-scFc VH CDR3 | GAYTYGFDY |
| 199. | MU 7-G6 CC × I2C0-scFc VL CDR1 | RASQSINRYLA |
| 200. | MU 7-G6 CC × I2C0-scFc VL CDR2 | TASNRAT |
| 201. | MU 7-G6 CC × I2C0-scFc VL CDR3 | HHYGSSIFT |
| 202. | MU 7-G6 CC × I2C0-SCFc VH | QVQLVESGGGVVKPGGSLRLSCAASGFTFSSYGMHWVRQAPGKCLEWV AVIWYSGSNKYYATSVKGRFTISRDNSKNTLYLQMNNLRAEDTAVYYC ARGAYTYGFDYWGQGTLVTVSS |
| 203. | MU 7-G6 CC × I2C0-SCFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 204. | MU 7-G6 CC × I2C0-scFc scFv | QVQLVESGGGVVKPGGSLRLSCAASGFTFSSYGMHWVRQAPGKCLEWV AVIWYSGSNKYYATSVKGRFTISRDNSKNTLYLQMNNLRAEDTAVYYC ARGAYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 205. | MU 7-G6 CC × I2C0-scFc Bispecific molecule | QVQLVESGGGVVKPGGSLRLSCAASGFTFSSYGMHWVRQAPGKCLEWV AVIWYSGSNKYYATSVKGRFTISRDNSKNTLYLQMNNLRAEDTAVYYC ARGAYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 206. | MU 7-G6 CC × I2C0-scFc Bispecific HLE molecule | QVQLVESGGGVVKPGGSLRLSCAASGFTFSSYGMHWVRQAPGKCLEWV AVIWYSGSNKYYATSVKGRFTISRDNSKNTLYLQMNNLRAEDTAVYYC ARGAYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 207. | MU 6-B12 CC × I2C0-scFc VH CDR1 | SYGMH |
| 208. | MU 6-B12 CC × I2C0-scFc VH CDR2 | VIWFDASNKYYAESVKG |
| 209. | MU 6-B12 CC × I2C0-scFc VH CDR3 | GAYTYGFDY |

-continued

| SEQ ID NO: | Description | Sequence |
|---|---|---|
| 210. | MU 6-B12 CC × I2C0-scFc VL CDR1 | RASQSINRYLA |
| 211. | MU 6-B12 CC × I2C0-scFc VL CDR2 | TASNRAT |
| 212. | MU 6-B12 CC × I2C0-SCFc VL CDR3 | HHYGSSIFT |
| 213. | MU 6-B12 CC × I2C0-SCFc VH | QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSS |
| 214. | MU 6-B12 CC × I2C0-SCFc VL | EIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 215. | MU 6-B12 CC × I2C0-scFc scFv | QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 216. | MU 6-B12 CC × I2C0-scFc Bispecific molecule | QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 217. | MU 6-B12 CC × I2C0-scFc Bispecific HLE molecule | QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 218. | MU 5-H4 CC × I2C0-scFc VH CDR1 | SYGMH |
| 219. | MU 5-H4 CC × I2C0-scFc VH CDR2 | VIWFQGSNKYYADAVKG |
| 220. | MU 5-H4 CC × I2C0-scFc VH CDR3 | GGYTYGFDY |
| 221. | MU 5-H4 CC × I2C0-scFc VL CDR1 | RASQSINRYLA |
| 222. | MU 5-H4 CC × I2C0-SCFc VL CDR2 | TASNRAT |
| 223. | MU 5-H4 CC × I2C0-SCFc VL CDR3 | HHYGSSIFT |

-continued

| SEQ ID NO: | Description | Sequence |
|---|---|---|
| 224. | MU 5-H4 CC × I2C0-scFc VH | QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSS |
| 225. | MU 5-H4 CC × I2C0-scFc VL | EIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 226. | MU 5-H4 CC × I2C0-scFc scFv | QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 227. | MU 5-H4 CC × I2C0-scFc Bispecific molecule | QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 228. | MU 5-H4 CC × I2C0-scFc Bispecific HLE molecule | QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 229. | MU 5-H1 CC × I2C0-scFc VH CDR1 | SGGYNWA |
| 230. | MU 5-H1 CC × I2C0-scFc VH CDR2 | YIYYSGSTYYNPSLKS |
| 231. | MU 5-H1 CC × I2C0-scFc VH CDR3 | EKYSSRWTFFDY |
| 232. | MU 5-H1 CC × I2C0-scFc VL CDR1 | SGDKLGDNYAS |
| 233. | MU 5-H1 CC × I2C0-scFc VL CDR2 | HDNKRPS |
| 234. | MU 5-H1 CC × I2C0-scFc VL CDR3 | QAFQSSTVV |
| 235. | MU 5-H1 CC × I2C0-scFc VH | QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSS |
| 236. | MU 5-H1 CC × I2C0-scFc VL | SYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVL |

-continued

| SEQ ID NO: | Description | Sequence |
|---|---|---|
| 237. | MU 5-H1 CC × I2C0-scFc scFv | QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVL |
| 238. | MU 5-H1 CC × I2C0-scFc Bispecific molecule | QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 239. | MU 5-H1 CC × I2C0-scFc Bispecific HLE molecule | QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNykttppvldsdgsfflyskltvdksrwqqgnvfscsvmhealhnhytqKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 240. | MU 4-HH CC × I2C0-scFc VH CDR1 | NFGMH |
| 241. | MU 4-HH CC × I2C0-scFc VH CDR2 | VIWFDASKTYYAEAVKG |
| 242. | MU 4-HH CC × I2C0-SCFc VH CDR3 | ATYSTGWSYFDY |
| 243. | MU 4-HH CC × I2C0-SCFc VL CDR1 | SGDKLGDKYTS |
| 244. | MU 4-HH CC × I2C0-SCFc VL CDR2 | HDAKRPS |
| 245. | MU 4-HH CC × I2C0-SCFc VL CDR3 | QAYEASTAWV |
| 246. | MU 4-HH CC × I2C0-SCFc VH | QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSS |
| 247. | MU 4-HH CC × I2C0-SCFc VL | SYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVL |
| 248. | MU 4-HH CC × I2C0-scFc scFv | QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVL |

-continued

| SEQ ID NO: | Description | Sequence |
|---|---|---|
| 249. | MU 4-HH CC × I2C0-scFc Bispecific molecule | QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 250. | MU 4-HH CC × I2C0-scFc Bispecific HLE molecule | QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNykttppvldsdgsfflyskltvdksrwqqgnvfscsvmhealhnhytqKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 251. | MU 4-H2 CC × I2C0-scFc VH CDR1 | NFGMH |
| 252. | MU 4-H2 CC × I2C0-SCFc VH CDR2 | VIWFDASKTYYAESVKG |
| 253. | MU 4-H2 CC × I2C0-SCFc VH CDR3 | ATYSTGWSYFDY |
| 254. | MU 4-H2 CC × I2C0-SCFc VL CDR1 | SGDKLGDKYTS |
| 255. | MU 4-H2 CC × I2C0-SCFc VL CDR2 | HDAKRPS |
| 256. | MU 4-H2 CC × I2C0-SCFc VL CDR3 | QAWEASTAWV |
| 257. | MU 4-H2 CC × I2C0-SCFc VH | QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSS |
| 258. | MU 4-H2 CC × I2C0-SCFc VL | SYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVL |
| 259. | MU 4-H2 CC × I2C0-scFc scFv | QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVL |
| 260. | MU 4-H2 CC × I2C0-scFc Bispecific molecule | QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNN |

-continued

| SEQ ID NO: | Description | Sequence |
|---|---|---|
| | | LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 261. | MU 4-H2 CC × I2C0-scFc Bispecific HLE molecule | QVQLVESGGGVVQPGRSLRLSCAASGFTFSNFGMHWVRQAPGKCLEWV AVIWFDASKTYYAESVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWEASTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVLGGGGDKTHTCPPCPAPELLGGPSVFLFPPK PKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPENN ykttppvldsdgsfflyskltvdksrwqqgnvfscsvmhealhnhytq KSLSLSPGKGGGGSGGGGSGGGGSGGGGSGGGGSGGGGSDKTHTCPPC PAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSN KALPAPIEKTISKAKGQPREPQVYTLPPSREEMTKNQVSLTCLVKGFY PSDIAVEWESNGQPENNYKTTPPVLDSDGSFFLYSKLTVDKSRWQQGN VFSCSVMHEALHNHYTQKSLSLSPGK |
| 262. | MU 4-G4 CC × I2C0-SCFc VH CDR1 | NFGMH |
| 263. | MU 4-G4 CC × I2C0-SCFc VH CDR2 | VIWFDASKTYYADAVKG |
| 264. | MU 4-G4 CC × I2C0-SCFc VH CDR3 | ATYSTGWSYFDY |
| 265. | MU 4-G4 CC × I2C0-SCFc VL CDR1 | SGDKLGDKYTS |
| 266. | MU 4-G4 CC × I2C0-SCFc VL CDR2 | HDAKRPS |
| 267. | MU 4-G4 CC × I2C0-SCFc VL CDR3 | QAWDASTAWV |
| 268. | MU 4-G4 CC × I2C0-SCFc VH | QVQLVESGGGVVQPGRSLRLSCAASGFTFSNFGMHWVRQAPGKCLEWV AVIWFDASKTYYADAVKGRFTISRDTSMNTLYLQMNSLRAEDTAVYYC ARATYSTGWSYFDYWGQGTLVTVSS |
| 269. | MU 4-G4 CC × I2C0-SCFc VL | SYELTQPPSVSVSPGQTASITCSGDKLGDKYTSWYQQKPGQSPVLVIY HDAKRPSGIPERFSGSNSGNTATLTISGTQAMDEADYYCQAWDASTAW VFGCGTKLTVL |
| 270. | MU 4-G4 CC × I2C0-scFc scFv | QVQLVESGGGVVQPGRSLRLSCAASGFTFSNFGMHWVRQAPGKCLEWV AVIWFDASKTYYADAVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWDASTAWVFGCGTKL TVL |
| 271. | MU 4-G4 CC × I2C0-scFc Bispecific molecule | QVQLVESGGGVVQPGRSLRLSCAASGFTFSNFGMHWVRQAPGKCLEWV AVIWFDASKTYYADAVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWDASTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |

-continued

| SEQ ID NO: | Description | Sequence |
|---|---|---|
| 272. | MU 4-G4 CC × I2C0-scFc Bispecific HLE molecule | QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNykttppvldsdgsfflyskltvdksrwqqgnvfscsvmhealhnhytqKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 273. | MU 4-F6 CC × I2C0-SCFc VH CDR1 | NFGMH |
| 274. | MU 4-F6 CC × I2C0-SCFc VH CDR2 | VIWFDASKTYYASSVKG |
| 275. | MU 4-F6 CC × I2C0-SCFc VH CDR3 | ATYSTGWSYFDY |
| 276. | MU 4-F6 CC × I2C0-SCFc VL CDR1 | SGDKLGDKYTS |
| 277. | MU 4-F6 CC × I2C0-SCFc VL CDR2 | HDAKRPS |
| 278. | MU 4-F6 CC × I2C0-SCFc VL CDR3 | QAYSASTAWV |
| 279. | MU 4-F6 CC × I2C0-SCFc VH | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSS |
| 280. | MU 4-F6 CC × I2C0-SCFc VL | SYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVL |
| 281. | MU 4-F6 CC × I2C0-scFc scFv | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVL |
| 282. | MU 4-F6 CC × I2C0-scFc Bispecific molecule | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 283. | MU 4-F6 CC × I2C0-scFc Bispecific HLE molecule | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNN |

-continued

| SEQ ID NO: | Description | Sequence |
|---|---|---|
| | | LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVLGGGGDKTHTCPPCPAPELLGGPSVFLFPPK PKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPENN ykttppvldsdgsfflyskltvdksrwqqgnvfscsvmhealhnhytq KSLSLSPGKGGGGSGGGGSGGGGSGGGGSGGGGSGGGGSDKTHTCPPC PAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSN KALPAPIEKTISKAKGQPREPQVYTLPPSREEMTKNQVSLTCLVKGFY PSDIAVEWESNGQPENNYKTTPPVLDSDGSFFLYSKLTVDKSRWQQGN VFSCSVMHEALHNHYTQKSLSLSPGK |
| 284. | MU 4-E7 CC × I2C0-SCFc VH CDR1 | GYYWS |
| 285. | MU 4-E7 CC × I2C0-SCFc VH CDR2 | DIDYSGSTKYNPSLKS |
| 286. | MU 4-E7 CC × I2C0-SCFc VH CDR3 | KKYSTVWSYFDY |
| 287. | MU 4-E7 CC × I2C0-SCFc VL CDR1 | SGDKLGEKYAS |
| 288. | MU 4-E7 CC × I2C0-SCFc VL CDR2 | QDRKRPS |
| 289. | MU 4-E7 CC × I2C0-SCFc VL CDR3 | QAWGSSAAV |
| 290. | MU 4-E7 CC × I2C0-SCFc VH | QVQLQQWGAGLLKPSETLSLTCAVYGGSFSGYYWSWIRQPPGKCLEWI GDIDYSGSTKYNPSLKSRVTISLDTSKNQFSLKLNSVTAADTAVYFCA RKKYSTVWSYFDYWGQGTLVTVSS |
| 291. | MU 4-E7 CC × I2C0-SCFc VL | SYELTQPSSVSVSPGQTASITCSGDKLGEKYASWYQQKPGQSPVLIIY QDRKRPSGVPERFSGSNSGNTATLTISGTQAMDEADYYCQAWGSSAAV FGCGTKLTVL |
| 292. | MU 4-E7 CC × I2C0-scFc scFv | QVQLQQWGAGLLKPSETLSLTCAVYGGSFSGYYWSWIRQPPGKCLEWI GDIDYSGSTKYNPSLKSRVTISLDTSKNQFSLKLNSVTAADTAVYFCA RKKYSTVWSYFDYWGQGTLVTVSSGGGGSGGGGSGGGGSSYELTQPSS VSVSPGQTASITCSGDKLGEKYASWYQQKPGQSPVLIIYQDRKRPSGV PERFSGSNSGNTATLTISGTQAMDEADYYCQAWGSSAAVFGCGTKLTV L |
| 293. | MU 4-E7 CC × I2C0-scFc Bispecific molecule | QVQLQQWGAGLLKPSETLSLTCAVYGGSFSGYYWSWIRQPPGKCLEWI GDIDYSGSTKYNPSLKSRVTISLDTSKNQFSLKLNSVTAADTAVYFCA RKKYSTVWSYFDYWGQGTLVTVSSGGGGSGGGGSGGGGSSYELTQPSS VSVSPGQTASITCSGDKLGEKYASWYQQKPGQSPVLIIYQDRKRPSGV PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 294. | MU 4-E7 CC × I2C0-scFc Bispecific HLE molecule | QVQLQQWGAGLLKPSETLSLTCAVYGGSFSGYYWSWIRQPPGKCLEWI GDIDYSGSTKYNPSLKSRVTISLDTSKNQFSLKLNSVTAADTAVYFCA RKKYSTVWSYFDYWGQGTLVTVSSGGGGSGGGGSGGGGSSYELTQPSS VSVSPGQTASITCSGDKLGEKYASWYQQKPGQSPVLIIYQDRKRPSGV PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS |

-continued

| SEQ ID NO: | Description | Sequence |
|---|---|---|
| | | LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |
| 295. | MU 4-C11 CC × I2C0-SCFc VH CDR1 | SYGMH |
| 296. | MU 4-C11 CC × I2C0-SCFc VH CDR2 | VIS YDASNKYYASAVKG |
| 297. | MU 4-C11 CC × I2C0-SCFc VH CDR3 | GAYTYGFDY |
| 298. | MU 4-C11 CC × I2C0-SCFc VL CDR1 | RASQSVNRYLA |
| 299. | MU 4-C11 CC × I2C0-SCFc VL CDR2 | GASNRAT |
| 300. | MU 4-C11 CC × I2C0-SCFc VL CDR3 | HHYGSSIFA |
| 301. | MU 4-C11 CC × I2C0-SCFc VH | QVQLVESGGGVVQPGRSLRLSCAASGFTFSSYGMHWVRQAPGKCLEWV AVISYDASNKYYASAVKGRFTISRDNSKNTLYLQMNSLRAEDTAVYYC ARGAYTYGFDYWGQGTLVTVSS |
| 302. | MU 4-C11 CC × I2C0-SCFc VL | EIVLTQSPGTLSLSPGERATLSCRASQSVNRYLAWYQQKPGQAPRLLI YGASNRATGIPDRFTGSGSGTDFTLTISRLEPEDFAVYFCHHYGSSIF AFGCGTKVEIK |
| 303. | MU 4-C11 CC × I2C0-scFc scFv | QVQLVESGGGVVQPGRSLRLSCAASGFTFSSYGMHWVRQAPGKCLEWV AVISYDASNKYYASAVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK |
| 304. | MU 4-C11 CC × I2C0-scFc Bispecific molecule | QVQLVESGGGVVQPGRSLRLSCAASGFTFSSYGMHWVRQAPGKCLEWV AVISYDASNKYYASAVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 305. | MU 4-C11 CC × I2C0-scFc Bispecific HLE molecule | QVQLVESGGGVVQPGRSLRLSCAASGFTFSSYGMHWVRQAPGKCLEWV AVISYDASNKYYASAVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |

-continued

| SEQ ID NO: | Description | Sequence |
|---|---|---|
| 306. | MU 4-C4 CC × I2C0-SCFc VH CDR1 | SYGMH |
| 307. | MU 4-C4 CC × I2C0-SCFc VH CDR2 | VIWFDASNKYYAESVKG |
| 308. | MU 4-C4 CC × I2C0-SCFc VH CDR3 | GAYTYGFDY |
| 309. | MU 4-C4 CC × I2C0-SCFc VL CDR1 | RASQSVNRYLA |
| 310. | MU 4-C4 CC × I2C0-SCFc VL CDR2 | GASNRAT |
| 311. | MU 4-C4 CC × I2C0-SCFc VL CDR3 | HHYGSSIFA |
| 312. | MU 4-C4 CC × I2C0-SCFc VH | QVQLVESGGGVVQPGRSLRLSCAASGFTFSSYGMHWVRQAPGKCLEWV AVIWFDASNKYYAESVKGRFTISRDNSKNTLYLQMNSLRAEDTAVYYC ARGAYTYGFDYWGQGTLVTVSS |
| 313. | MU 4-C4 CC × I2C0-SCFc VL | EIVLTQSPGTLSLSPGERATLSCRASQSVNRYLAWYQQKPGQAPRLLI YGASNRATGIPDRFTGSGSGTDFTLTISRLEPEDFAVYFCHHYGSSIF AFGCGTKVEIK |
| 314. | MU 4-C4 CC × I2C0-scFc scFv | QVQLVESGGGVVQPGRSLRLSCAASGFTFSSYGMHWVRQAPGKCLEWV AVIWFDASNKYYAESVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK |
| 315. | MU 4-C4 CC × I2C0-scFc Bispecific molecule | QVQLVESGGGVVQPGRSLRLSCAASGFTFSSYGMHWVRQAPGKCLEWV AVIWFDASNKYYAESVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 316. | MU 4-C4 CC × I2C0-scFc Bispecific HLE molecule | QVQLVESGGGVVQPGRSLRLSCAASGFTFSSYGMHWVRQAPGKCLEWV AVIWFDASNKYYAESVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 317. | MU 4-C3 CC × I2C0-SCFc VH CDR1 | SYGMH |
| 318. | MU 4-C3 CC × I2C0-SCFc VH CDR2 | VISYEGSNKYYAESVKG |
| 319. | MU 4-C3 CC × I2C0-SCFc VH CDR3 | GAYTYGFDY |

-continued

| SEQ ID NO: | Description | Sequence |
|---|---|---|
| 320. | MU 4-C3 CC × I2C0-SCFc VL CDR1 | RASQSVNRYLA |
| 321. | MU 4-C3 CC × I2C0-SCFc VL CDR2 | GASNRAT |
| 322. | MU 4-C3 CC × I2C0-SCFc VL CDR3 | HHYGSSIFA |
| 323. | MU 4-C3 CC × I2C0-SCFc VH | QVQLVESGGGVVQPGRSLRLSCAASGFTFSSYGMHWVRQAPGKCLEWV AVISYEGSNKYYAESVKGRFTISRDNSKNTLYLQMNSLRAEDTAVYYC ARGAYTYGFDYWGQGTLVTVSS |
| 324. | MU 4-C3 CC × I2C0-SCFc VL | EIVLTQSPGTLSLSPGERATLSCRASQSVNRYLAWYQQKPGQAPRLLI YGASNRATGIPDRFTGSGSGTDFTLTISRLEPEDFAVYFCHHYGSSIF AFGCGTKVEIK |
| 325. | MU 4-C3 CC × I2C0-scFc | QVQLVESGGGVVQPGRSLRLSCAASGFTFSSYGMHWVRQAPGKCLEWV AVISYEGSNKYYAESVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK |
| 326. | MU 4-C3 CC × I2C0-scFc Bispecific molecule | QVQLVESGGGVVQPGRSLRLSCAASGFTFSSYGMHWVRQAPGKCLEWV AVISYEGSNKYYAESVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 327. | MU 4-C3 CC × I2C0-scFc Bispecific HLE molecule | QVQLVESGGGVVQPGRSLRLSCAASGFTFSSYGMHWVRQAPGKCLEWV AVISYEGSNKYYAESVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 328. | MU 4-B10 CC × I2C0-SCFc VH CDR1 | NFGMH |
| 329. | MU 4-B10 CC × I2C0-SCFc VH CDR2 | VIWFDASKTYYASSVKG |
| 330. | MU 4-B10 CC × I2C0-SCFc VH CDR3 | ATYSTGWSYFDY |
| 331. | MU 4-B10 CC × I2C0-SCFc VL CDR1 | SGDKLGDKYTS |
| 332. | MU 4-B10 CC × I2C0-SCFc VL CDR2 | HDAKRPS |
| 333. | MU 4-B10 CC × I2C0-SCFc VL CDR3 | QAWSASTAWV |

-continued

| SEQ ID NO: | Description | Sequence |
| --- | --- | --- |
| 334. | MU 4-B10 CC × I2C0-SCFc VH | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSS |
| 335. | MU 4-B10 CC × I2C0-SCFc VL | SYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL |
| 336. | MU 4-B10 CC × I2C0-scFc scFv | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL |
| 337. | MU 4-B10 CC × I2C0-scFc Bispecific molecule | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 338. | MU 4-B10 CC × I2C0-scFc Bispecific HLE molecule | QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNykttppvldsdgsfflyskltvdksrwqqgnvfscsvmhealhnhytqKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 339. | MU 4-B6 CC × I2C0-SCFc VH CDR1 | SYGMH |
| 340. | MU 4-B6 CC × I2C0-SCFc VH CDR2 | VISYDASNKYYASSVKG |
| 341. | MU 4-B6 CC × I2C0-SCFc VH CDR3 | GAYTYGFDY |
| 342. | MU 4-B6 CC × I2C0-SCFc VL CDR1 | RASQSVNRYLA |
| 343. | MU 4-B6 CC × I2C0-SCFc VL CDR2 | GASNRAT |
| 344. | MU 4-B6 CC × I2C0-SCFc VL CDR3 | HHYGSSIFA |
| 345. | MU 4-B6 CC × I2C0-SCFc VH | QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSS |
| 346. | MU 4-B6 CC × I2C0-SCFc VL | EIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK |

| SEQ ID NO: | Description | Sequence |
|---|---|---|
| 347. | MU 4-B6 CC × I2C0-scFc scFv | QVQLVESGGGVVQPGRSLRLSCAASGFTFSSYGMHWVRQAPGKCLEWV AVISYDASNKYYASSVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK |
| 348. | MU 4-B6 CC × I2C0-scFc Bispecific molecule | QVQLVESGGGVVQPGRSLRLSCAASGFTFSSYGMHWVRQAPGKCLEWV AVISYDASNKYYASSVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 349. | MU 4-B6 CC × I2C0-scFc Bispecific HLE molecule | QVQLVESGGGVVQPGRSLRLSCAASGFTFSSYGMHWVRQAPGKCLEWV AVISYDASNKYYASSVKGRFTISRDNSKNTLYLQMNSLRAEDTAVYYC ARGAYTYGFDYWGQGTLVTVSSGGGGSGGGGSGGGGSEIVLTQSPGTL SLSPGERATLSCRASQSVNRYLAWYQQKPGQAPRLLIYGASNRATGIP DRFTGSGSGTDFTLTISRLEPEDFAVYFCHHYGSSIFAFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 350. | MU 4-B1 CC × I2C0-scFc VH CDR1 | NFGMH |
| 351. | MU 4-B1 CC × I2C0-scFc VH CDR2 | VIWFDASKTYYAESVKG |
| 352. | MU 4-B1 CC × I2C0-scFc VH CDR3 | ATYSTGWSYFDY |
| 353. | MU 4-B1 CC × I2C0-scFc VL CDR1 | SGDKLGDKYTS |
| 354. | MU 4-B1 CC × I2C0-scFc VL CDR2 | HDAKRPS |
| 355. | MU 4-B1 CC × I2C0-scFc VL CDR3 | QAWSASTAWV |
| 356. | MU 4-B1 CC × I2C0-scFc VH | QVQLVESGGGVVQPGRSLRLSCAASGFTFSNFGMHWVRQAPGKCLEWV AVIWFDASKTYYAESVKGRFTISRDTSMNTLYLQMNSLRAEDTAVYYC ARATYSTGWSYFDYWGQGTLVTVSS |
| 357. | MU 4-B1 CC × I2C0-scFc VL | SYELTQPPSVSVSPGQTASITCSGDKLGDKYTSWYQQKPGQSPVLVIY HDAKRPSGIPERFSGSNSGNTATLTISGTQAMDEADYYCQAWSASTAW VFGCGTKLTVL |
| 358. | MU 4-B1 CC × I2C0-scFc scFv | QVQLVESGGGVVQPGRSLRLSCAASGFTFSNFGMHWVRQAPGKCLEWV AVIWFDASKTYYAESVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWSASTAWVFGCGTKL TVL |

-continued

| SEQ ID NO: | Description | Sequence |
|---|---|---|
| 359. | MU 4-B1 CC × I2C0-scFc Bispecific molecule | QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 360. | MU 4-B1 CC × I2C0-scFc Bispecific HLE molecule | QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNykttppvldsdgsfflyskltvdksrwqqgnvfscsvmhealhnhytqKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 361. | MU 4-A8 CC × I2C0-scFc VH CDR1 | NFGMH |
| 362. | MU 4-A8 CC × I2C0-scFc VH CDR2 | VIWFDASKTYYADAVKG |
| 363. | MU 4-A8 CC × I2C0-scFc VH CDR3 | ATYSTGWSYFDY |
| 364. | MU 4-A8 CC × I2C0-scFc VL CDR1 | SGDKLGDKYTS |
| 365. | MU 4-A8 CC × I2C0-scFc VL CDR2 | HDAKRPS |
| 366. | MU 4-A8 CC × I2C0-scFc VL CDR3 | QAWSASTAWV |
| 367. | MU 4-A8 CC × I2C0-scFc VH | QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSS |
| 368. | MU 4-A8 CC × I2C0-scFc VL | SYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL |
| 369. | MU 4-A8 CC × I2C0-scFc scFv | QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL |
| 370. | MU 4-A8 CC × I2C0-scFc Bispecific molecule | QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNN |

-continued

| SEQ ID NO: | Description | Sequence |
|---|---|---|
| | | LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 371. | MU 4-A8 CC × I2C0-scFc Bispecific HLE molecule | QVQLVESGGGVVQPGRSLRLSCAASGFTFSNFGMHWVRQAPGKCLEWV AVIWFDASKTYYADAVKGRFTISRDTSMNTLYLQMNSLRAEDTAVYYC ARATYSTGWSYFDYWGQGTLVTVSSGGGGSGGGGSGGGGSSYELTQPP SVSVSPGQTASITCSGDKLGDKYTSWYQQKPGQSPVLVIYHDAKRPSG IPERFSGSNSGNTATLTISGTQAMDEADYYCQAWSASTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVLGGGGDKTHTCPPCPAPELLGGPSVFLFPPK PKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPENN ykttppvldsdgsfflyskltvdksrwqqgnvfscsvmhealhnhytq KSLSLSPGKGGGGSGGGGSGGGGSGGGGSGGGGSGGGGSDKTHTCPPC PAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSN KALPAPIEKTISKAKGQPREPQVYTLPPSREEMTKNQVSLTCLVKGFY PSDIAVEWESNGQPENNYKTTPPVLDSDGSFFLYSKLTVDKSRWQQGN VFSCSVMHEALHNHYTQKSLSLSPGK |
| 372. | MU 3-C10 CC × I2C0-scFc VH CDR1 | SYGMH |
| 373. | MU 3-C10 CC × I2C0-scFc VH CDR2 | VIWYSGSNKYYATSVKG |
| 374. | MU 3-C10 CC × I2C0-scFc VH CDR3 | GGYTYGFDY |
| 375. | MU 3-C10 CC × I2C0-scFc VL CDR1 | RASQSINRYLA |
| 376. | MU 3-C10 CC × I2C0-scFc VL CDR2 | TASNRAT |
| 377. | MU 3-C10 CC × I2C0-scFc VL CDR3 | HHYGSSIFT |
| 378. | MU 3-C10 CC × I2C0-scFc VH | QVQLVESGGGVVKPGRSLRLSCAASGFTFSSYGMHWVRQAPGKCLEWV AVIWYSGSNKYYATSVKGRFTISRDNSKNTLYLQMNNLRAEDTAVYYC ARGGYTYGFDYWGQGTLVTVSS |
| 379. | MU 3-C10 CC × I2C0-scFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 380. | MU 3-C10 CC × I2C0-scFc scFv | QVQLVESGGGVVKPGRSLRLSCAASGFTFSSYGMHWVRQAPGKCLEWV AVIWYSGSNKYYATSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 381. | MU 3-C10 CC × I2C0-scFc Bispecific molecule | QVQLVESGGGVVKPGRSLRLSCAASGFTFSSYGMHWVRQAPGKCLEWV AVIWYSGSNKYYATSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 382. | MU 3-C10 CC × I2C0-scFc Bispecific HLE molecule | QVQLVESGGGVVKPGRSLRLSCAASGFTFSSYGMHWVRQAPGKCLEWV AVIWYSGSNKYYATSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP |

-continued

| SEQ ID NO: | Description | Sequence |
|---|---|---|
| | | DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 383. | MU 2-F7 CC × I2C0-scFc VH CDR1 | SYGMH |
| 384. | MU 2-F7 CC × I2C0-scFc VH CDR2 | VIWFDASNKYYAESVKG |
| 385. | MU 2-F7 CC × I2C0-scFc VH CDR3 | GGYTYGFDY |
| 386. | MU 2-F7 CC × I2C0-scFc VL CDR1 | RASQSINRYLA |
| 387. | MU 2-F7 CC × I2C0-scFc VL CDR2 | TASNRAT |
| 388. | MU 2-F7 CC × I2C0-scFc VL CDR3 | HHYGSSIFT |
| 389. | MU 2-F7 CC × I2C0-scFc VH | QVQLVESGGGLVKPGGSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSS |
| 390. | MU 2-F7 CC × I2C0-scFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 391. | MU 2-F7 CC × I2C0-scFc scFv | QVQLVESGGGLVKPGGSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 392. | MU 2-F7 CC × I2C0-scFc Bispecific molecule | QVQLVESGGGLVKPGGSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 393. | MU 2-F7 CC × I2C0-scFc Bispecific HLE molecule | QVQLVESGGGLVKPGGSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE |

-continued

| SEQ ID NO: | Description | Sequence |
|---|---|---|
| | | PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 394. | MU 02-E7 CC × I2C0-scFc VH CDR1 | SYGMH |
| 395. | MU 02-E7 CC × I2C0-scFc VH CDR2 | VIWYTGSNKYYAHSVKG |
| 396. | MU 02-E7 CC × I2C0-scFc VH CDR3 | GAYTYGFDY |
| 397. | MU 02-E7 CC × I2C0-scFc VL CDR1 | RASQSINRYLA |
| 398. | MU 02-E7 CC × I2C0-scFc VL CDR2 | TASNRAT |
| 399. | MU 02-E7 CC × I2C0-scFc VL CDR3 | HHYGSSIFT |
| 400. | MU 02-E7 CC × I2C0-scFc VH | QVQLVESGGGVVQPGGSLRLSCAASGFTFSSYGMHWVRQAPGKCLEWV AVIWYTGSNKYYAHSVKGRFAISRDNSKNTLYLQMNNLRAEDTAVYYC ARGAYTYGFDYWGQGTLVTVSS |
| 401. | MU 02-E7 CC × I2C0-scFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 402. | MU 02-E7 CC × I2C0-scFc scFv | QVQLVESGGGVVQPGGSLRLSCAASGFTFSSYGMHWVRQAPGKCLEWV AVIWYTGSNKYYAHSVKGRFAISRDNSKNTLYLQMNNLRAEDTAVYYC ARGAYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 403. | MU 02-E7 CC × I2C0-scFc Bispecific molecule | QVQLVESGGGVVQPGGSLRLSCAASGFTFSSYGMHWVRQAPGKCLEWV AVIWYTGSNKYYAHSVKGRFAISRDNSKNTLYLQMNNLRAEDTAVYYC ARGAYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 404. | MU 02-E7 CC × I2C0-scFc Bispecific HLE molecule | QVQLVESGGGVVQPGGSLRLSCAASGFTFSSYGMHWVRQAPGKCLEWV AVIWYTGSNKYYAHSVKGRFAISRDNSKNTLYLQMNNLRAEDTAVYYC ARGAYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |

-continued

| SEQ ID NO: | Description | Sequence |
|---|---|---|
| 405. | MU 2-D11 CC × I2C0-scFc VH CDR1 | NHGMH |
| 406. | MU 2-DH CC × I2C0-scFc VH CDR2 | GIWSDASNKYYAEAVKG |
| 407. | MU 2-D11 CC × I2C0-scFc VH CDR3 | ATYTTGWSYFDY |
| 408. | MU 2-DH CC × I2C0-scFc VL CDR1 | SGDKLGDKYTS |
| 409. | MU 2-D11 CC × I2C0-scFc VL CDR2 | HDRKRPS |
| 410. | MU 2-DH CC × I2C0-scFc VL CDR3 | QAYDRSTAWV |
| 411. | MU 2-DH CC × I2C0-scFc VH | QVQLVESGGGVVQPGRSLRLSCAASGFTFSNHGMHWVRQAPGKCLEWV AGIWSDASNKYYAEAVKGRFTISRDTSKNTLYLQMNSLRAEDTAVYYC ARATYTTGWSYFDYWGQGTLVTVSS |
| 412. | MU 2-DH CC × I2C0-scFc VL | SYELTQSPSVSVSPGQTASITCSGDKLGDKYTSWYQQKPGQSPVLVIY HDRKRPSGIPERFSGSNSGNTATLTISGTQAMDEADYYCQAYDRSTAW VFGCGTKLTVL |
| 413. | MU 2-DH CC × I2C0-scFc scFv | QVQLVESGGGVVQPGRSLRLSCAASGFTFSNHGMHWVRQAPGKCLEWV AGIWSDASNKYYAEAVKGRFTISRDTSKNTLYLQMNSLRAEDTAVYYC ARATYTTGWSYFDYWGQGTLVTVSSGGGGSGGGGSGGGGSSYELTQSP SVSVSPGQTASITCSGDKLGDKYTSWYQQKPGQSPVLVIYHDRKRPSG IPERFSGSNSGNTATLTISGTQAMDEADYYCQAYDRSTAWVFGCGTKL TVL |
| 414. | MU 2-DH CC × I2C0-scFc Bispecific molecule | QVQLVESGGGVVQPGRSLRLSCAASGFTFSNHGMHWVRQAPGKCLEWV AGIWSDASNKYYAEAVKGRFTISRDTSKNTLYLQMNSLRAEDTAVYYC ARATYTTGWSYFDYWGQGTLVTVSSGGGGSGGGGSGGGGSSYELTQSP SVSVSPGQTASITCSGDKLGDKYTSWYQQKPGQSPVLVIYHDRKRPSG IPERFSGSNSGNTATLTISGTQAMDEADYYCQAYDRSTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 415. | MU 2-D11 CC × I2C0-scFc Bispecific HLE molecule | QVQLVESGGGVVQPGRSLRLSCAASGFTFSNHGMHWVRQAPGKCLEWV AGIWSDASNKYYAEAVKGRFTISRDTSKNTLYLQMNSLRAEDTAVYYC ARATYTTGWSYFDYWGQGTLVTVSSGGGGSGGGGSGGGGSSYELTQSP SVSVSPGQTASITCSGDKLGDKYTSWYQQKPGQSPVLVIYHDRKRPSG IPERFSGSNSGNTATLTISGTQAMDEADYYCQAYDRSTAWVFGCGTKL TVLSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVLGGGGDKTHTCPPCPAPELLGGPSVFLFPPK PKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQ PREPQVYTLPPSREEMTKNQVSLTCLVKGFYPSDIAVEWESNGQPENN ykttppvldsdgsfflyskltvdksrwqqgnvfscsvmhealhnhytq KSLSLSPGKGGGGSGGGGSGGGGSGGGGSGGGGSGGGGSDKTHTCPPC PAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSN KALPAPIEKTISKAKGQPREPQVYTLPPSREEMTKNQVSLTCLVKGFY PSDIAVEWESNGQPENNYKTTPPVLDSDGSFFLYSKLTVDKSRWQQGN VFSCSVMHEALHNHYTQKSLSLSPGK |
| 416. | MU 2-C2 CC × I2C0-scFc VH CDR1 | NHGMH |
| 417. | MU 2-C2 CC × I2C0-scFc VH CDR2 | GIWSEGSNKYYADAVKG |
| 418. | MU 2-C2 CC × I2C0-scFc VH CDR3 | ATYTTGWSYFDY |

-continued

| SEQ ID NO: | Description | Sequence |
|---|---|---|
| 419. | MU 2-C2 CC × I2C0-scFc VL CDR1 | SGDKLGDKYAS |
| 420. | MU 2-C2 CC × I2C0-scFc VL CDR2 | QDAKRPS |
| 421. | MU 2-C2 CC × I2C0-scFc VL CDR3 | QAFHQSTWV |
| 422. | MU 2-C2 CC × I2C0-scFc VH | QVQLVESGGGVVQPGRSLRLSCAASGFTFSNHGMHWVRQAPGKCLEWV AGIWSEGSNKYYADAVKGRFTISRDNSKNTLYLQMNSLRAEDTAVYYC ARATYTTGWSYFDYWGQGTLVTVSS |
| 423. | MU 2-C2 CC × I2C0-SCFc VL | SYELTQPPSVSVSPGQTASITCSGDKLGDKYASWYQQKSGQSPVLVIY QDAKRPSGIPERFSGSNSGNTATLTISGTQAMDEADYYCQAFHQSTWV FGCGTQLTVL |
| 424. | MU 2-C2 CC × I2C0-scFc scFv | QVQLVESGGGVVQPGRSLRLSCAASGFTFSNHGMHWVRQAPGKCLEWV AGIWSEGSNKYYADAVKGRFTISRDNSKNTLYLQMNSLRAEDTAVYYC ARATYTTGWSYFDYWGQGTLVTVSSGGGGSGGGGSGGGGSSYELTQPP SVSVSPGQTASITCSGDKLGDKYASWYQQKSGQSPVLVIYQDAKRPSG IPERFSGSNSGNTATLTISGTQAMDEADYYCQAFHQSTWVFGCGTQLT VL |
| 425. | MU 2-C2 CC × I2C0-scFc Bispecific molecule | QVQLVESGGGVVQPGRSLRLSCAASGFTFSNHGMHWVRQAPGKCLEWV AGIWSEGSNKYYADAVKGRFTISRDNSKNTLYLQMNSLRAEDTAVYYC ARATYTTGWSYFDYWGQGTLVTVSSGGGGSGGGGSGGGGSSYELTQPP SVSVSPGQTASITCSGDKLGDKYASWYQQKSGQSPVLVIYQDAKRPSG IPERFSGSNSGNTATLTISGTQAMDEADYYCQAFHQSTWVFGCGTQLT VLSGGGGSEVQLVESGGGLVQPGGSLKLSCAASGFTFNKYAMNWVRQA PGKGLEWVARIRSKYNNYATYYADSVKDRFTISRDDSKNTAYLQMNNL KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVL |
| 426. | MU 2-C2 CC × I2C0-scFc Bispecific HLE molecule | QVQLVESGGGVVQPGRSLRLSCAASGFTFSNHGMHWVRQAPGKCLEWV AGIWSEGSNKYYADAVKGRFTISRDNSKNTLYLQMNSLRAEDTAVYYC ARATYTTGWSYFDYWGQGTLVTVSSGGGGSGGGGSGGGGSSYELTQPP SVSVSPGQTASITCSGDKLGDKYASWYQQKSGQSPVLVIYQDAKRPSG IPERFSGSNSGNTATLTISGTQAMDEADYYCQAFHQSTWVFGCGTQLT VLSGGGGSEVQLVESGGGLVQPGGSLKLSCAASGFTFNKYAMNWVRQA PGKGLEWVARIRSKYNNYATYYADSVKDRFTISRDDSKNTAYLQMNNL KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVLGGGGDKTHTCPPCPAPELLGGPSVFLFPPKP KDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQP REPQVYTLPPSREEMTKNQVSLTCLVKGFYPSDIAVEWESNGQPENNY kttppvldsdgsfflyskltvdksrwqqgnvfscsvmhealhnhytqk SLSLSPGKGGGGSGGGGSGGGGSGGGGSGGGGSGGGGSDKTHTCPPCP APELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNK ALPAPIEKTISKAKGQPREPQVYTLPPSREEMTKNQVSLTCLVKGFYP SDIAVEWESNGQPENNYKTTPPVLDSDGSFFLYSKLTVDKSRWQQGNV FSCSVMHEALHNHYTQKSLSLSPGK |
| 427. | MU 2-A3 CC × I2C0-scFc VH CDR1 | SFGMH |
| 428. | MU 2-A3 CC × I2C0-scFc VH CDR2 | VIWFDASNKYYAESVKG |
| 429. | MU 2-A3 CC × I2C0-scFc VH CDR3 | GGYTYGFDY |
| 430. | MU 2-A3 CC × I2C0-scFc VL CDR1 | RASQAINRYLA |
| 431. | MU 2-A3 CC × I2C0-scFc VL CDR2 | GASSRAT |

-continued

| SEQ ID NO: | Description | Sequence |
|---|---|---|
| 432. | MU 2-A3 CC × I2C0-scFc VL CDR3 | QHYGSSIFT |
| 433. | MU 2-A3 CC × I2C0-SCFc VH | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSS |
| 434. | MU 2-A3 CC × I2C0-scFc | EIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIK |
| 435. | MU 2-A3 CC × I2C0-scFc SCFv VL | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIK |
| 436. | MU 2-A3 CC × I2C0-scFc Bispecific molecule | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 437. | MU 2-A3 CC × I2C0-scFc Bispecific HLE molecule | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 438. | MU 1-H2 CC × I2C0-scFc VH CDR1 | SYGMH |
| 439. | MU 1-H2 CC × I2C0-scFc VH CDR2 | VIWYDASNKYYATSVKG |
| 440. | MU 1-H2 CC × I2C0-scFc VH CDR3 | GGYTYGFDY |
| 441. | MU 1-H2 CC × I2C0-scFc VL CDR1 | RASQSINRYLA |
| 442. | MU 1-H2 CC × I2C0-scFc VL CDR2 | TASNRAT |
| 443. | MU 1-H2 CC × I2C0-SCFc VL CDR3 | HHYGSSIFT |
| 444. | MU 1-H2 CC × I2C0-SCFc VH | QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSS |

-continued

| SEQ ID NO: | Description | Sequence |
|---|---|---|
| 445. | MU 1-H2 CC × I2C0-SCFc VL | EIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 446. | MU 1-H2 CC × I2C0-scFc scFv | QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 447. | MU 1-H2 CC × I2C0-scFc Bispecific molecule | QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 448. | MU 1-H2 CC × I2C0-scFc Bispecific HLE molecule | QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 449. | MU 1-E9 CC × I2C0-scFc VH CDR1 | SYGMH |
| 450. | MU 1-E9 CC × I2C0-scFc VH CDR2 | VIWFHGSNKYYAESVKG |
| 451. | MU 1-E9 CC × I2C0-scFc VH CDR3 | GAYTYGFDY |
| 452. | MU 1-E9 CC × I2C0-scFc VL CDR1 | RASQSINRYLA |
| 453. | MU 1-E9 CC × I2C0-SCFc VL CDR2 | TASNRAT |
| 454. | MU 1-E9 CC × I2C0-SCFc VL CDR3 | HHYGSSIFT |
| 455. | MU 1-E9 CC × I2C0-SCFc VH | QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSS |
| 456. | MU 1-E9 CC × I2C0-SCFc VL | EIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |

-continued

| SEQ ID NO: | Description | Sequence |
|---|---|---|
| 457. | MU 1-E9 CC × I2C0-scFc scFv | QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK |
| 458. | MU 1-E9 CC × I2C0-scFc Bispecific molecule | QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 459. | MU 1-E9 CC × I2C0-scFc Bispecific HLE molecule | QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 460. | MU 1-B10 CC × I2C0-scFc VH CDR1 | NFGMH |
| 461. | MU 1-B10 CC × I2C0-scFc VH CDR2 | VIWFDASKTYYAEAVKG |
| 462. | MU 1-B10 CC × I2C0-scFc VH CDR3 | ATYSTGWSYFDY |
| 463. | MU 1-B10 CC × I2C0-SCFc VL CDR1 | SGDKLGDKYTS |
| 464. | MU 1-B10 CC × I2C0-SCFc VL CDR2 | HDAKRPS |
| 465. | MU 1-B10 CC × I2C0-SCFc VL CDR3 | QAWSASTAWV |
| 466. | MU 1-B10 CC × I2C0-SCFc VH | QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSS |
| 467. | MU 1-B10 CC × I2C0-SCFc VL | SYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL |
| 468. | MU 1-B10 CC × I2C0-scFc scFv | QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL |

-continued

| SEQ ID NO: | Description | Sequence |
|---|---|---|
| 469. | MU 1-B10 CC × I2C0-scFc Bispecific molecule | QVQLVESGGGVVQPGRSLRLSCAASGFTFSNFGMHWVRQAPGKCLEWV<br>AVIWFDASKTYYAEAVKGRFTISRDTSMNTLYLQMNSLRAEDTAVYYC<br>ARATYSTGWSYFDYWGQGTLVTVSSGGGGSGGGGSGGGGSSYELTQPP<br>SVSVSPGQTASITCSGDKLGDKYTSWYQQKPGQSPVLVIYHDAKRPSG<br>IPERFSGSNSGNTATLTISGTQAMDEADYYCQAWSASTAWVFGCGTKL<br>TVLSGGGGSEVQLVESGGGLVQPGGSLKLSCAASGFTFNKYAMNWVRQ<br>APGKGLEWVARIRSKYNNYATYYADSVKDRFTISRDDSKNTAYLQMNN<br>LKTEDTAVYYCVRHGNFGNSYISYWAYWGQGTLVTVSSGGGGSGGGGS<br>GGGGSQTVVTQEPSLTVSPGGTVTLTCGSSTGAVTSGNYPNWVQQKPG<br>QAPRGLIGGTKFLAPGTPARFSGSLLGGKAALTLSGVQPEDEAEYYCV<br>LWYSNRWVFGGGTKLTVL |
| 470. | MU 1-B10 CC × I2C0-scFc Bispecific HLE molecule | QVQLVESGGGVVQPGRSLRLSCAASGFTFSNFGMHWVRQAPGKCLEWV<br>AVIWFDASKTYYAEAVKGRFTISRDTSMNTLYLQMNSLRAEDTAVYYC<br>ARATYSTGWSYFDYWGQGTLVTVSSGGGGSGGGGSGGGGSSYELTQPP<br>SVSVSPGQTASITCSGDKLGDKYTSWYQQKPGQSPVLVIYHDAKRPSG<br>IPERFSGSNSGNTATLTISGTQAMDEADYYCQAWSASTAWVFGCGTKL<br>TVLSGGGGSEVQLVESGGGLVQPGGSLKLSCAASGFTFNKYAMNWVRQ<br>APGKGLEWVARIRSKYNNYATYYADSVKDRFTISRDDSKNTAYLQMNN<br>LKTEDTAVYYCVRHGNFGNSYISYWAYWGQGTLVTVSSGGGGSGGGGS<br>GGGGSQTVVTQEPSLTVSPGGTVTLTCGSSTGAVTSGNYPNWVQQKPG<br>QAPRGLIGGTKFLAPGTPARFSGSLLGGKAALTLSGVQPEDEAEYYCV<br>LWYSNRWVFGGGTKLTVLGGGGDKTHTCPPCPAPELLGGPSVFLFPPK<br>PKDTLMISRTPEVTCVVVDVSHEDPEVKFNWYVDGVEVHNAKTKPCEE<br>QYGSTYRCVSVLTVLHQDWLNGKEYKCKVSNKALPAPIEKTISKAKGQ<br>PREPQVYTLPPSREEMTKNQVSLTCLVKGFYPSDIAVEWESNGQPENN<br>ykttppvldsdgsfflyskltvdksrwqqgnvfscsvmhealhnhytq<br>KSLSLSPGKGGGGSGGGGSGGGGSGGGGSGGGGSGGGGSDKTHTCPPC<br>PAPELLGGPSVFLFPPKPKDTLMISRTPEVTCVVVDVSHEDPEVKFNW<br>YVDGVEVHNAKTKPCEEQYGSTYRCVSVLTVLHQDWLNGKEYKCKVSN<br>KALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQGN<br>VFSCSVMHEALHNHYTQKSLSLSPGK |
| 471. | MU 1-B6 CC × I2C0-scFc VH CDR1 | GYYWS |
| 472. | MU 1-B6 CC × I2C0-scFc VH CDR2 | DIDYSGSTKYNPSLKS |
| 473. | MU 1-B6 CC × I2C0-SCFc VH CDR3 | KKYSTVWSYFDY |
| 474. | MU 1-B6 CC × I2C0-SCFc VL CDR1 | SGDKLGDKYAN |
| 475. | MU 1-B6 CC × I2C0-SCFc VL CDR2 | HDNKRPS |
| 476. | MU 1-B6 CC × I2C0-SCFc VL CDR3 | QAYGISSAV |
| 477. | MU 1-B6 CC × I2C0-SCFc VH | QVQLQQWGAGLLKPSETLSLTCAVYGGSFSGYYWSWIRQPPGKCLEWI<br>GDIDYSGSTKYNPSLKSRVTISLDTSKNQFSLKLNSVTAADTAVYFCA<br>RKKYSTVWSYFDYWGQGTLVTVSS |
| 478. | MU 1-B6 CC × I2C0-SCFc VL | SYELTQPASASVSPGQTASITCSGDKLGDKYANWYQQKPGQSPILVIY<br>HDNKRPSGIPERFSGSNSGNTATLTISGTQAMDEADYYCQAYGISSAV<br>FGCGTKLTVL |
| 479. | MU 1-B6 CC × I2C0-scFc scFv | QVQLQQWGAGLLKPSETLSLTCAVYGGSFSGYYWSWIRQPPGKCLEWI<br>GDIDYSGSTKYNPSLKSRVTISLDTSKNQFSLKLNSVTAADTAVYFCA<br>RKKYSTVWSYFDYWGQGTLVTVSSGGGGSGGGGSGGGGSSYELTQPAS<br>ASVSPGQTASITCSGDKLGDKYANWYQQKPGQSPILVIYHDNKRPSGI<br>PERFSGSNSGNTATLTISGTQAMDEADYYCQAYGISSAVFGCGTKLTV<br>L |
| 480. | MU 1-B6 CC × I2C0-scFc Bispecific molecule | QVQLQQWGAGLLKPSETLSLTCAVYGGSFSGYYWSWIRQPPGKCLEWI<br>GDIDYSGSTKYNPSLKSRVTISLDTSKNQFSLKLNSVTAADTAVYFCA<br>RKKYSTVWSYFDYWGQGTLVTVSSGGGGSGGGGSGGGGSSYELTQPAS<br>ASVSPGQTASITCSGDKLGDKYANWYQQKPGQSPILVIYHDNKRPSGI<br>PERFSGSNSGNTATLTISGTQAMDEADYYCQAYGISSAVFGCGTKLTV<br>LSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK |

-continued

| SEQ ID NO: | Description | Sequence |
|---|---|---|
| | | TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 481. | MU 1-B6 CC × I2C0-scFc Bispecific HLE molecule | QVQLQQWGAGLLKPSETLSLTCAVYGGSFSGYYWSWIRQPPGKCLEWI GDIDYSGSTKYNPSLKSRVTISLDTSKNQFSLKLNSVTAADTAVYFCA RKKYSTVWSYFDYWGQGTLVTVSSGGGGSGGGGSGGGGSSYELTQPAS ASVSPGQTASITCSGDKLGDKYANWYQQKPGQSPILVIYHDNKRPSGI PERFSGSNSGNTATLTISGTQAMDEADYYCQAYGISSAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |
| 482. | MU 1-A6 CC × I2C0-scFc VH CDR1 | GYYWS |
| 483. | MU 1-A6 CC × I2C0-SCFc VH CDR2 | DIDQSGSTKYNPSLKS |
| 484. | MU 1-A6 CC × I2C0-SCFc VH CDR3 | KKYSTVWSYFDY |
| 485. | MU 1-A6 CC × I2C0-SCFc VL CDR1 | SGDKLGDKYAS |
| 486. | MU 1-A6 CC × I2C0-SCFc VL CDR2 | QDRKRPS |
| 487. | MU 1-A6 CC × I2C0-SCFc VL CDR3 | QAWGSSAAV |
| 488. | MU 1-A6 CC × I2C0-SCFc VH | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWGQGTLVTVSS |
| 489. | MU 1-A6 CC × I2C0-SCFc VL | SYELTQPSSVSVPPGQTASITCSGDKLGDKYASWYQQKPGQSPVLVIY QDRKRPSGVPERFSGSNSGNTATLTISGTQAMDEADYYCQAWGSSAAV FGCGTKLTVL |
| 490. | MU 1-A6 CC × I2C0-scFc scFv | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWGQGTLVTVSSGGGGSGGGGSGGGGSSYELTQPSS VSVPPGQTASITCSGDKLGDKYASWYQQKPGQSPVLVIYQDRKRPSGV PERFSGSNSGNTATLTISGTQAMDEADYYCQAWGSSAAVFGCGTKLTV L |
| 491. | MU 1-A6 CC × I2C0-scFc Bispecific molecule | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWGQGTLVTVSSGGGGSGGGGSGGGGSSYELTQPSS VSVPPGQTASITCSGDKLGDKYASWYQQKPGQSPVLVIYQDRKRPSGV PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 492. | MU 1-A6 CC × I2C0-scFc Bispecific HLE molecule | QVQLQQWGAGLLKPSETLSLTCAVYGGSFSGYYWSWIRQPPGKCLEWI GDIDQSGSTKYNPSLKSRVTISLDTSKNQFSLKLNSVTAADTAVYFCA RKKYSTVWSYFDYWGQGTLVTVSSGGGGSGGGGSGGGGSSYELTQPSS |

-continued

| SEQ ID NO: | Description | Sequence |
| --- | --- | --- |
| | | VSVPPGQTASITCSGDKLGDKYASWYQQKPGQSPVLVIYQDRKRPSGV PERFSGSNSGNTATLTISGTQAMDEADYYCQAWGSSAAVFGCGTKLTV LSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVLGGGGDKTHTCPPCPAPELLGGPSVFLFPPKPK DTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPR EPQVYTLPPSREEMTKNQVSLTCLVKGFYPSDIAVEWESNGQPENNYK TTPPVLDSDGSFFLYSKLTVDKSRWQQGNVFSCSVMHEALHNHYTQKS LSLSPGKGGGGSGGGGSGGGGSGGGGSGGGGSGGGGSDKTHTCPPCPA PELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPS DIAVEWESNGQPENNYKTTPPVLDSDGSFFLYSKLTVDKSRWQQGNVF SCSVMHEALHNHYTQKSLSLSPGK |
| 493. | MU 0-F9 CC × I2C0-scFc VH CDR1 | SFGMH |
| 494. | MU 0-F9 CC × I2C0-SCFc VH CDR2 | VIWYTGSNKYYASSVKG |
| 495. | MU 0-F9 CC × I2C0-SCFc VH CDR3 | GGYTYGFDY |
| 496. | MU 0-F9 CC × I2C0-SCFc VL CDR1 | RASQSINRYLA |
| 497. | MU 0-F9 CC × I2C0-SCFc VL CDR2 | TASNRAT |
| 498. | MU 0-F9 CC × I2C0-SCFc VL CDR3 | HHYGSSIFT |
| 499. | MU 0-F9 CC × I2C0-SCFc VH | QVQLVESGGGLVKPGGSLRLSCAASGFTFSSFGMHWVRQAPGKCLEWV AVIWYTGSNKYYASSVKGRFTISRDNSKNTLYLQMNNLRAEDTAVYYC ARGGYTYGFDYWGQGTLVTVSS |
| 500. | MU 0-F9 CC × I2C0-SCFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 501. | MU 0-F9 CC × I2C0-scFc scFv | QVQLVESGGGLVKPGGSLRLSCAASGFTFSSFGMHWVRQAPGKCLEWV AVIWYTGSNKYYASSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 502. | MU 0-F9 CC × I2C0-scFc Bispecific molecule | QVQLVESGGGLVKPGGSLRLSCAASGFTFSSFGMHWVRQAPGKCLEWV AVIWYTGSNKYYASSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 503. | MU 0-F9 CC × I2C0-scFc Bispecific HLE molecule | QVQLVESGGGLVKPGGSLRLSCAASGFTFSSFGMHWVRQAPGKCLEWV AVIWYTGSNKYYASSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG |

-continued

| SEQ ID NO: | Description | Sequence |
|---|---|---|
| | | STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 504. | MU 0-F6 CC × I2C0-SCFc VH CDR1 | SYGMH |
| 505. | MU 0-F6 CC × I2C0-SCFc VH CDR2 | VIWFDASNKYYAESVKG |
| 506. | MU 0-F6 CC × I2C0-SCFc VH CDR3 | GGYTYGFDY |
| 507. | MU 0-F6 CC × I2C0-SCFc VL CDR1 | RASQSINRYLA |
| 508. | MU 0-F6 CC × I2C0-SCFc VL CDR2 | TASNRAT |
| 509. | MU 0-F6 CC × I2C0-SCFc VL CDR3 | HHYGSSIFT |
| 510. | MU 0-F6 CC × I2C0-SCFc VH | QVQLVESGGGLVKPGRSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSS |
| 511. | MU 0-F6 CC × I2C0-SCFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 512. | MU 0-F6 CC × I2C0-scFc scFv | QVQLVESGGGLVKPGRSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 513. | MU 0-F6 CC × I2C0-scFc Bispecific molecule | QVQLVESGGGLVKPGRSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 514. | MU 0-F6 CC × I2C0-scFc Bispecific HLE molecule | QVQLVESGGGLVKPGRSLRLSCAASGFTFSSYGMHWVRQAPGKCLEWV AVIWFDASNKYYAESVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |

-continued

| SEQ ID NO: | Description | Sequence |
|---|---|---|
| 515. | MU 0-E5 CC × I2C0-SCFc VH CDR1 | SYGMH |
| 516. | MU 0-E5 CC × I2C0-SCFc VH CDR2 | VIWYDASNKYYATSVKG |
| 517. | MU 0-E5 CC × I2C0-SCFc VH CDR3 | GGYTYGFDY |
| 518. | MU 0-E5 CC × I2C0-SCFc VL CDR1 | RASQSINRYLA |
| 519. | MU 0-E5 CC × I2C0-SCFc VL CDR2 | TASNRAT |
| 520. | MU 0-E5 CC × I2C0-SCFc VL CDR3 | HHYGSSIFT |
| 521. | MU 0-E5 CC × I2C0-SCFc VH | QVQLVESGGGVVKPGRSLRLSCAASGFTFSSYGMHWVRQAPGKCLEWV AVIWYDASNKYYATSVKGRFTISRDNSKNTLYLQMNNLRAEDTAVYYC ARGGYTYGFDYWGQGTLVTVSS |
| 522. | MU 0-E5 CC × I2C0-SCFc VL | EIVLTQSPGTLSLSPGERATLSCRASQSINRYLAWYQQKPGQAPRLLI YTASNRATGIPDRFSGSGSGTDFTLTISRLEPEDFAVYYCHHYGSSIF TFGCGTKVEIK |
| 523. | MU 0-E5 CC × I2C0-scFc scFv | QVQLVESGGGVVKPGRSLRLSCAASGFTFSSYGMHWVRQAPGKCLEWV AVIWYDASNKYYATSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK |
| 524. | MU 0-E5 CC × I2C0-scFc Bispecific molecule | QVQLVESGGGVVKPGRSLRLSCAASGFTFSSYGMHWVRQAPGKCLEWV AVIWYDASNKYYATSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVL |
| 525. | MU 0-E5 CC × I2C0-scFc Bispecific HLE molecule | QVQLVESGGGVVKPGRSLRLSCAASGFTFSSYGMHWVRQAPGKCLEWV AVIWYDASNKYYATSVKGRFTISRDNSKNTLYLQMNNLRAEDTAVYYC ARGGYTYGFDYWGQGTLVTVSSGGGGSGGGGSGGGGSEIVLTQSPGTL SLSPGERATLSCRASQSINRYLAWYQQKPGQAPRLLIYTASNRATGIP DRFSGSGSGTDFTLTISRLEPEDFAVYYCHHYGSSIFTFGCGTKVEIK SGGGGSEVQLVESGGGLVQPGGSLKLSCAASGFTFNKYAMNWVRQAPG KGLEWVARIRSKYNNYATYYADSVKDRFTISRDDSKNTAYLQMNNLKT EDTAVYYCVRHGNFGNSYISYWAYWGQGTLVTVSSGGGGSGGGGSGGG GSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWY SNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYG STYRCVSVLTVLHQDWLNGKEYKCKVSNKALPAPIEKTISKAKGQPRE PQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSL SLSPGKGGGGSGGGGSGGGGSGGGGSGGGGSGGGGSDKTHTCPPCPAP ELLGGPSVFLFPPKPKDTLMISRTPEVTCVVVDVSHEDPEVKFNWYVD GVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSD IAVEWESNGQPENNYKTTPPVLDSDGSFFLYSKLTVDKSRWQQGNVFS CSVMHEALHNHYTQKSLSLSPGK |
| 526. | MUC17 epitope E2 | EVVSSIDIGPPETISAQMELTVTVTSVKFTEELKNHSSQEFQEFKQTF TEQMNIVYSGIPEYVGVNITKLRLGSVVVEHDVLLRTKYTPEYKTVLD NATEVVKEKITKVTTQQIMINDICSDMMCF |
| 527. | MUC17 epitope E2 (N-term shortened) | SAQMELTVTVTSVKFTEELKNHSSQEFQEFKQTFTEQMNIVYSGIPEY VGVNITKLRLGSVVVEHDVLLRTKYTPEYKTVLDNATEVVKEKITKVT TQQIMINDICS |

-continued

| SEQ ID NO: | Description | Sequence |
|---|---|---|
| 528. | MUC17 epitope 5A (comprises part of E2) | rtttcfgdgcqntasrcknggtwdglkcqcpnlyygelceevvssidi GPPETISAQMELTVTVTSVKFTEELKNHSSQEFQEFKQTFTEQMNIVY SGIPEYVGVNITKLRLG |
| 529. | MUC17 epitope 5B (comprises part of E2) | SVVVEHDVLLRTKYTPEYKTVLDNATEVVKEKITKVTTQQIMINDICS DMMCFNTTGTQVQNITVTQYDPEEDCRKMAKEYGDYFVVEYRDQKPYC ISPCEPGFSVSKNCNLGKCQMSLSGPQCLCVTTETHWYSGETCNQGTQ KS |
| 530. | MUC17 epitope E2 trunk2 | EVVSSIDIGPPETISAQMELTVTVTSVKFTEELKNHSSQEFQEFKQTF TEQMNIVYSGIPEYVGVNITKLRLGSVVVEHDVLLRTKYTPEYKTVLD NATEVVKEKITKVTTQQIMINDICSDMMCFNTTGTQVQNITVTQYDPE EDCRKMAKEYGDYFVVEYRDQKPYCISPCEPGFSVSKNCNLGKCQMSL SGPQCLCVTTETHWYSGETCNQGTQKSL |
| 531. | MUC17 epitope E2 trunk3 | ISAQMELTVTVTSVKFTEELKNHSSQEFQEFKQTFTEQMNIVYSGIPE YVGVNITKLRLGSVVVEHDVLLRTKYTPEYKTVLDNATEVVKEKITKV TTQQIMINDICSDMMCFNTTGTQVQNITVTQYDPEEDCRKMAKEYGDY FVVEYRDQKPYCISPCEPGFSVSKNCNLGKCQMSLSGPQCLCVTTETH WYSGETCNQGTQKSL |
| 532. | MUC17 epitope E2 trunk4 | DMMCFNTTGTQVQNITVTQYDPEEDCRKMAKEYGDYFVVEYRDQKPYC ISPCEPGFSVSKNCNLGKCQMSLSGPQCLCVTTETHWYSGETCNQGTQ KSL |
| 533. | MUC17 epitope E2 trunk5 | SPCEPGFSVSKNCNLGKCQMSLSGPQCLCVTTETHWYSGETCNQGTQK SL |

EXAMPLES

Generation of Anti-Human MUC17 IHC Reagent—Immunization and Hybridoma Generation Hybridomas were generated that selectively identify anti-human MUC17 in immunohistochemistry. The so produced antibodies recognize the membrane form and not the secreted form of MUC17. To this end, B6 mice were DNA immunized via gene gun with a vector (pTT5:VK102012:: huMUC17(4131-4493)::E3k or with whole CHO cells (or 293 cells) transiently expressing huMUC17. Produced antibodies were screened on alternate cells transiently expressing huMUC17. Surface and intracellular staining by FACS or CellInsight was performed as described below.

Fused hybridomas were plated at monoclonal densities and a primary screen on 293 cells transiently expressing huMUC17 was made (surface staining and fixed permeabilized assays). Positive hits were identified by Alamar Blue assay (daughter plates made and Alamar Blue added to identify wells with live cells by reading at OD650). The Alamar blue assay was run twice separated by 5 days to verify also small slow growing colonies that did not transfer cells to the daughter plates. A counterscreen on huMUC17 secreted form by ELISA assay. Positive hits were rearrayed, reconfirmed in assays and tested for binding to cynomolgus monkey MUC17 membrane form using FACS staining.

Conventional FACS staining was made to stain cells with antibodies that may be used to determine if cells express a huMUC17 or cynomolgus monkey MUC17 on their surface and if an antibody recognizes a specific protein expressed on the cell surface. This way, 33 hybridomas were identified that stained huMUC17 on the surface of the cell and a substantially number of hybridomas were identified that could stain the fixed permeabilized cells, presumably the intracellular portion of huMUC17. All the surface staining hits could also stain the fixed epitopes. These hits were all carried forward into large scale cultures with no subcloning Antibody sequences were all determined by sequencing antibodies having good specificity for huMUC17 in IHC were selected. Hybridoma derived antibodies have a higher degree of nonspecific staining on endogenous tissues in IHC were de-selected.

The antibody according to the present invention has a remarkable selectivity for huMUC17 in IHC and has advantageously good specificity for the detection of said protein in tumor tissues, whereas other antibodies had less suitability for IHC applications.

Histology—Slide Production, Staining, and Review

For each human and cynomolgus macaque tissue for which an adjacent formalin-fixed paraffin-embedded tissue was also collected, a 4-micron section was cut from the paraffin blocks using a Leica microtome. The section was placed briefly on a warm water bath and then placed on a microscopy slide. Slides were stained with hematoxylin and eosin using a Sakura Tissue-Tek Prisma autostainer and reagents from Leica Biosystems (Hematoxylin 560, Alcoholic Eosin Y 515, Define, and Blue Buffer 8) following the protocol detailed in Table 5. Coverslips were mechanically applied to stained slides using a Sakura auto-coverslipper according to the manufacturer's recommended procedure. Each slide was examined under a light microscope by a board-certified veterinary pathologist. Any tissue that did not appear histologically normal was omitted from further processing.

Figure 1B:
Figure 1C:
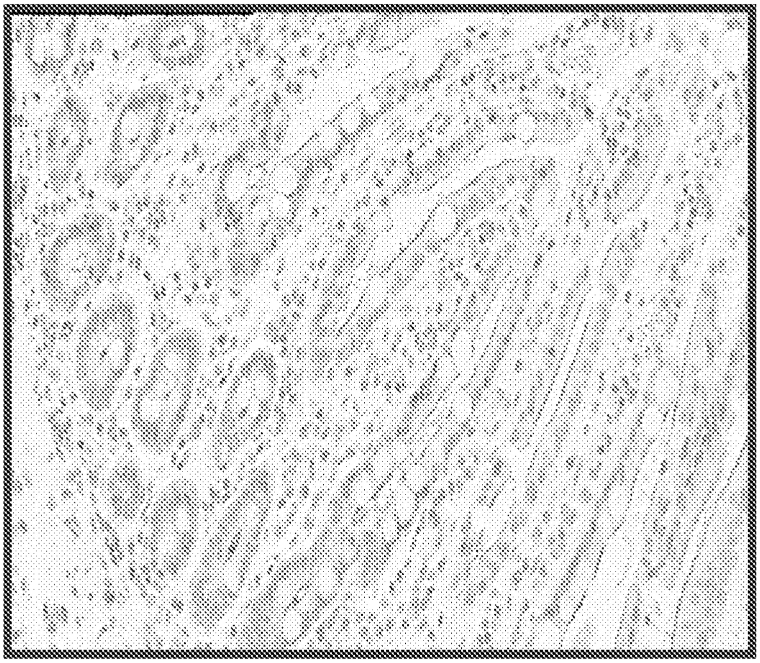

IHC results using the antibody of the invention are shown in FIG. 1A-C demonstrating that MUC17 is Highly Expressed in Gastric Cancer Immunohistochemistry reveals multifocal, diffuse MUC17 staining (brown stain) in metastatic gastric cancer tissue sections (FIG. 1A and FIG. 1B) whereas MUC17 expression is confined to the apical membrane in normal enterocytes (FIG. 1C).

SEQUENCE LISTING (533 sequences)

SEQ ID NO: 1 - protein, 4493 aa, Homo Sapiens
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 2 - protein, 5 aa, Artificial Sequence
  Synthetic
GNFLN

SEQ ID NO: 3 - protein, 17 aa, Artificial Sequence
  Synthetic
RITPYSGETFYNQKFKD

SEQ ID NO: 4 - protein, 14 aa, Artificial Sequence
  Synthetic
GVTTEVSHYYAMDY

SEQ ID NO: 5 - protein, 472 aa, Artificial Sequence
  Synthetic
MGWSWIFLFLLSVTAGVFSEVQLQQSGPELVKPGDSVKISCKASGYSFTGNFLNWVMQSHGKSLEWIGRITPYSGETFYNQKFKDKATLTVDISSSIAHMELRSLTSEDSAVYYCARGVTTEVSHYYAMDYWGQGTAVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 6 - protein, 11 aa, Artificial Sequence
  Synthetic
HASQNINLWLH

SEQ ID NO: 7 - protein, 7 aa, Artificial Sequence
  Synthetic
KASNLHT

SEQ ID NO: 8 - protein, 9 aa, Artificial Sequence
  Synthetic
QQGQSYPLT

SEQ ID NO: 9 - protein, 234 aa, Artificial Sequence
  Synthetic
MRVLAELLGLLLFCFLGVRCDIQMNQSPSSLSASLGDTITITCHASQNINLWLHWYQQKPGNIPKLLIFKASNLHTGVPLRFSGSGSGTGFTLTISSLQPEDIATYFCQQGQSYPLTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 10 - protein, 5 aa, Artificial Sequence
  Synthetic
GGGGS

SEQ ID NO: 11 - protein, 10 aa, Artificial Sequence
  Synthetic
GGGGSGGGGS

SEQ ID NO: 12 - protein, 15 aa, Artificial Sequence
  Synthetic
GGGGSGGGGSGGGGS

SEQ ID NO: 13 - protein, 25 aa, Artificial Sequence
  Synthetic
GGGGSGGGGSGGGGSGGGGSGGGGS

SEQ ID NO: 14 - protein, 30 aa, Artificial Sequence
  Synthetic
GGGGSGGGGSGGGGSGGGGSGGGGSGGGGS

SEQ ID NO: 15 - protein, 35 aa, Artificial Sequence
  Synthetic
GGGGSGGGGSGGGGSGGGGSGGGGSGGGGSGGGGS

SEQ ID NO: 16 - protein, 40 aa, Artificial Sequence
  Synthetic
GGGGSGGGGSGGGGSGGGGSGGGGSGGGGSGGGGSGGGGS

SEQ ID NO: 17 - protein, 6 aa, Artificial Sequence
  Synthetic
PGGGGS

SEQ ID NO: 18 - protein, 6 aa, Artificial Sequence
  Synthetic
PGGDGS

SEQ ID NO: 19 - protein, 6 aa, Artificial Sequence
  Synthetic
SGGGGS

SEQ ID NO: 20 - protein, 4 aa, Artificial Sequence
  Synthetic
GGGG

SEQ ID NO: 21 - protein, 249 aa, Artificial Sequence
  Synthetic
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 22 - protein, 227 aa, Artificial Sequence
  Synthetic
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 225 aa, Artificial Sequence
  Synthetic
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 24 - protein, 227 aa, Artificial Sequence
  Synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 225 aa, Artificial Sequence
  Synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 26 - protein, 227 aa, Artificial Sequence
  Synthetic
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 225 aa, Artificial Sequence
  Synthetic
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 28 - protein, 227 aa, Artificial Sequence
  Synthetic
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 225 aa, Artificial Sequence
  Synthetic
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 30 - protein, 484 aa, Artificial Sequence
  Synthetic
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 5 aa, Artificial Sequence
  Synthetic
SYGMH

SEQ ID NO: 32 - protein, 17 aa, Artificial Sequence
  Synthetic
VISFEGSNKYYASSVKG

SEQ ID NO: 33 - protein, 9 aa, Artificial Sequence
  Synthetic
GAYTYGFDY

SEQ ID NO: 34 - protein, 11 aa, Artificial Sequence
  Synthetic
RASQSVNRYLA

SEQ ID NO: 35 - protein, 7 aa, Artificial Sequence
  Synthetic
GASNRAT

SEQ ID NO: 36 - protein, 9 aa, Artificial Sequence
  Synthetic
HHYGSSIFA

SEQ ID NO: 37 - protein, 118 aa, Artificial Sequence
  Synthetic
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSS

SEQ ID NO: 38 - protein, 107 aa, Artificial Sequence
  Synthetic
EIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 39 - protein, 240 aa, Artificial Sequence
  Synthetic
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 40 - protein, 495 aa, Artificial Sequence
  Synthetic
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 41 - protein, 983 aa, Artificial Sequence
  Synthetic
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 5 aa, Artificial Sequence
  Synthetic
SFGMH

SEQ ID NO: 43 - protein, 17 aa, Artificial Sequence
  Synthetic
VIWFSGSNKYYAEAVKG

SEQ ID NO: 44 - protein, 9 aa, Artificial Sequence
  Synthetic
GGYTYGFDY

SEQ ID NO: 45 - protein, 11 aa, Artificial Sequence
  Synthetic
RANQAINRYLA

SEQ ID NO: 46 - protein, 7 aa, Artificial Sequence
  Synthetic
GASSRAT

SEQ ID NO: 47 - protein, 9 aa, Artificial Sequence
  Synthetic
HHYGSSIFT

SEQ ID NO: 48 - protein, 118 aa, Artificial Sequence
  Synthetic
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSS

SEQ ID NO: 49 - protein, 107 aa, Artificial Sequence
  Synthetic
EIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIK

SEQ ID NO: 50 - protein, 240 aa, Artificial Sequence
  Synthetic
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSSGGGGSGGGGSGGGGSEIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIK

SEQ ID NO: 51 - protein, 495 aa, Artificial Sequence
  Synthetic
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSSGGGGSGGGGSGGGGSEIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 52 - protein, 983 aa, Artificial Sequence
  Synthetic
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSSGGGGSGGGGSGGGGSEIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 5 aa, Artificial Sequence
  Synthetic
NHAMH

SEQ ID NO: 54 - protein, 17 aa, Artificial Sequence
  Synthetic
GIWSEGSNKYYAESVKG

SEQ ID NO: 55 - protein, 12 aa, Artificial Sequence
  Synthetic
ATYTTGWSYFDY

SEQ ID NO: 56 - protein, 11 aa, Artificial Sequence
  Synthetic
SGDKLGDKYAS

SEQ ID NO: 57 - protein, 7 aa, Artificial Sequence
  Synthetic
QDRKRPS

SEQ ID NO: 58 - protein, 9 aa, Artificial Sequence
  Synthetic
QAYDASTWV

SEQ ID NO: 59 - protein, 121 aa, Artificial Sequence
  Synthetic
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSS

SEQ ID NO: 60 - protein, 106 aa, Artificial Sequence
  Synthetic
SYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVL

SEQ ID NO: 61 - protein, 242 aa, Artificial Sequence
  Synthetic
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVL

SEQ ID NO: 62 - protein, 497 aa, Artificial Sequence
  Synthetic
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 63 - protein, 985 aa, Artificial Sequence
  Synthetic
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 5 aa, Artificial Sequence
  Synthetic
NFGMH

SEQ ID NO: 65 - protein, 17 aa, Artificial Sequence
  Synthetic
VIWFDASKTYYASSVKG

SEQ ID NO: 66 - protein, 12 aa, Artificial Sequence
  Synthetic
ATYSTGWSYFDY

SEQ ID NO: 67 - protein, 11 aa, Artificial Sequence
  Synthetic
SGDKLGDKYTS

SEQ ID NO: 68 - protein, 7 aa, Artificial Sequence
  Synthetic
HDAKRPS

SEQ ID NO: 69 - protein, 10 aa, Artificial Sequence
  Synthetic
QAWDASTAWV

SEQ ID NO: 70 - protein, 121 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSS

SEQ ID NO: 71 - protein, 107 aa, Artificial Sequence
  Synthetic
SYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVL

SEQ ID NO: 72 - protein, 243 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVL

SEQ ID NO: 73 - protein, 498 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 74 - protein, 986 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 5 aa, Artificial Sequence
  Synthetic
GYYWS

SEQ ID NO: 76 - protein, 16 aa, Artificial Sequence
  Synthetic
DIEHSGSTKYNPSLKS

SEQ ID NO: 77 - protein, 12 aa, Artificial Sequence
  Synthetic
KKYSTVWSYFDY

SEQ ID NO: 78 - protein, 11 aa, Artificial Sequence
  Synthetic
SGDKLGDKYAS

SEQ ID NO: 79 - protein, 7 aa, Artificial Sequence
  Synthetic
HDNKRPS

SEQ ID NO: 80 - protein, 9 aa, Artificial Sequence
  Synthetic
QAYGSSSAV

SEQ ID NO: 81 - protein, 120 aa, Artificial Sequence
  Synthetic
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSS

SEQ ID NO: 82 - protein, 106 aa, Artificial Sequence
  Synthetic
SYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVL

SEQ ID NO: 83 - protein, 241 aa, Artificial Sequence
  Synthetic
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSSGGGGSGGGGSGGGGSSYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVL

SEQ ID NO: 84 - protein, 496 aa, Artificial Sequence
  Synthetic
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSSGGGGSGGGGSGGGGSSYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 85 - protein, 984 aa, Artificial Sequence
  Synthetic
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSSGGGGSGGGGSGGGGSSYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 5 aa, Artificial Sequence
  Synthetic
GYYWS

SEQ ID NO: 87 - protein, 16 aa, Artificial Sequence
  Synthetic
DIDASGSTKYNPSLKS

SEQ ID NO: 88 - protein, 12 aa, Artificial Sequence
  Synthetic
KKYSTVWSYFDY

SEQ ID NO: 89 - protein, 11 aa, Artificial Sequence
  Synthetic
SGDKLGDKYAS

SEQ ID NO: 90 - protein, 7 aa, Artificial Sequence
  Synthetic
QDRKRPS

SEQ ID NO: 91 - protein, 9 aa, Artificial Sequence
  Synthetic
QAWGSSTAV

SEQ ID NO: 92 - protein, 120 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSS

SEQ ID NO: 93 - protein, 106 aa, Artificial Sequence
  Synthetic
SYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVL

SEQ ID NO: 94 - protein, 241 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVL

SEQ ID NO: 95 - protein, 496 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 96 - protein, 984 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 5 aa, Artificial Sequence
  Synthetic
SFGMH

SEQ ID NO: 98 - protein, 17 aa, Artificial Sequence
  Synthetic
VIWFDASNKYYAESVKG

SEQ ID NO: 99 - protein, 9 aa, Artificial Sequence
  Synthetic
GGYTYGFDY

SEQ ID NO: 100 - protein, 11 aa, Artificial Sequence
  Synthetic
RASQAVNRYLA

SEQ ID NO: 101 - protein, 7 aa, Artificial Sequence
  Synthetic
GASSRAT

SEQ ID NO: 102 - protein, 9 aa, Artificial Sequence
  Synthetic
QQYGSSIFT

SEQ ID NO: 103 - protein, 118 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSS

SEQ ID NO: 104 - protein, 107 aa, Artificial Sequence
  Synthetic
EIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK

SEQ ID NO: 105 - protein, 240 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK

SEQ ID NO: 106 - protein, 495 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 107 - protein, 983 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 5 aa, Artificial Sequence
  Synthetic
SHYWS

SEQ ID NO: 109 - protein, 16 aa, Artificial Sequence
  Synthetic
RIDVSGSANYNPALKS

SEQ ID NO: 110 - protein, 12 aa, Artificial Sequence
  Synthetic
APYSSGWGYFDY

SEQ ID NO: 111 - protein, 11 aa, Artificial Sequence
  Synthetic
SGDKLGDKYAS

SEQ ID NO: 112 - protein, 7 aa, Artificial Sequence
  Synthetic
HDNKRPS

SEQ ID NO: 113 - protein, 9 aa, Artificial Sequence
  Synthetic
QAWDITTAV

SEQ ID NO: 114 - protein, 120 aa, Artificial Sequence
  Synthetic
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSS

SEQ ID NO: 115 - protein, 106 aa, Artificial Sequence
  Synthetic
SYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVL

SEQ ID NO: 116 - protein, 241 aa, Artificial Sequence
  Synthetic
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVL

SEQ ID NO: 117 - protein, 496 aa, Artificial Sequence
  Synthetic
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 118 - protein, 984 aa, Artificial Sequence
  Synthetic
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 5 aa, Artificial Sequence
  Synthetic
GYYWS

SEQ ID NO: 120 - protein, 16 aa, Artificial Sequence
  Synthetic
DIDASGSTKYNPSLKS

SEQ ID NO: 121 - protein, 12 aa, Artificial Sequence
  Synthetic
KKYSTVWSYFDY

SEQ ID NO: 122 - protein, 11 aa, Artificial Sequence
  Synthetic
SGDKLGDKYAS

SEQ ID NO: 123 - protein, 7 aa, Artificial Sequence
  Synthetic
QDRKRPS

SEQ ID NO: 124 - protein, 9 aa, Artificial Sequence
  Synthetic
QAWGSSAAV

SEQ ID NO: 125 - protein, 120 aa, Artificial Sequence; identical to SEQ ID NO: 92
  Synthetic

SEQ ID NO: 126 - protein, 106 aa, Artificial Sequence
  Synthetic
SYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 127 - protein, 241 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 128 - protein, 496 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 129 - protein, 984 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 5 aa, Artificial Sequence
  Synthetic
NHGMH

SEQ ID NO: 131 - protein, 17 aa, Artificial Sequence
  Synthetic
GIWSDASNKYYADAVKG

SEQ ID NO: 132 - protein, 12 aa, Artificial Sequence
  Synthetic
ATYTTGWSYFDY

SEQ ID NO: 133 - protein, 11 aa, Artificial Sequence
  Synthetic
SGDKLGDKYAS

SEQ ID NO: 134 - protein, 7 aa, Artificial Sequence
  Synthetic
QDNKRPS

SEQ ID NO: 135 - protein, 9 aa, Artificial Sequence
  Synthetic
QAYDASTWV

SEQ ID NO: 136 - protein, 121 aa, Artificial Sequence
  Synthetic
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSS

SEQ ID NO: 137 - protein, 106 aa, Artificial Sequence
  Synthetic
SYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVL

SEQ ID NO: 138 - protein, 242 aa, Artificial Sequence
  Synthetic
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVL

SEQ ID NO: 139 - protein, 497 aa, Artificial Sequence
  Synthetic
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 140 - protein, 985 aa, Artificial Sequence
  Synthetic
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - protein, 5 aa, Artificial Sequence
  Synthetic
GYYWS

SEQ ID NO: 142 - protein, 16 aa, Artificial Sequence
  Synthetic
DIDASGSTKYNPSLKS

SEQ ID NO: 143 - protein, 12 aa, Artificial Sequence
  Synthetic
KKYSTVWSYFDY

SEQ ID NO: 144 - protein, 11 aa, Artificial Sequence
  Synthetic
SGDKLGEKYAS

SEQ ID NO: 145 - protein, 7 aa, Artificial Sequence
  Synthetic
QDRKRPS

SEQ ID NO: 146 - protein, 9 aa, Artificial Sequence
  Synthetic
QAWGSSAAV

SEQ ID NO: 147 - protein, 120 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSS

SEQ ID NO: 148 - protein, 106 aa, Artificial Sequence
  Synthetic
SYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVL

SEQ ID NO: 149 - protein, 242 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSSGGGGSGGGGSGGGGSSYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVLS

SEQ ID NO: 150 - protein, 496 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSSGGGGSGGGGSGGGGSSYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 151 - protein, 984 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSSGGGGSGGGGSGGGGSSYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 5 aa, Artificial Sequence
  Synthetic
GYYWS

SEQ ID NO: 153 - protein, 16 aa, Artificial Sequence
  Synthetic
DIDQSGSTKYNPSLKS

SEQ ID NO: 154 - protein, 12 aa, Artificial Sequence
  Synthetic
KKYSTVWSYFDY

SEQ ID NO: 155 - protein, 11 aa, Artificial Sequence
  Synthetic
SGDKLGDKYAS

SEQ ID NO: 156 - protein, 7 aa, Artificial Sequence
  Synthetic
QDRKRPS

SEQ ID NO: 157 - protein, 9 aa, Artificial Sequence
  Synthetic
QAWGSSAAV

SEQ ID NO: 158 - protein, 120 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSS

SEQ ID NO: 159 - protein, 106 aa, Artificial Sequence
  Synthetic
SYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 160 - protein, 241 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 161 - protein, 496 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 162 - protein, 984 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 5 aa, Artificial Sequence
  Synthetic
GYYWS

SEQ ID NO: 164 - protein, 16 aa, Artificial Sequence
  Synthetic
DIDQSGSTKYNPSLKS

SEQ ID NO: 165 - protein, 12 aa, Artificial Sequence
  Synthetic
KKYSTVWSYFDY

SEQ ID NO: 166 - protein, 11 aa, Artificial Sequence
  Synthetic
SGDKLGDKYAS

SEQ ID NO: 167 - protein, 7 aa, Artificial Sequence
  Synthetic
QDRKRPS

SEQ ID NO: 168 - protein, 9 aa, Artificial Sequence
  Synthetic
QAWGSSAAV

SEQ ID NO: 169 - protein, 120 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSS

SEQ ID NO: 170 - protein, 106 aa, Artificial Sequence
  Synthetic
SYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 171 - protein, 241 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 172 - protein, 496 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 173 - protein, 984 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 5 aa, Artificial Sequence
  Synthetic
GYYWS

SEQ ID NO: 175 - protein, 16 aa, Artificial Sequence
  Synthetic
DIDASGSTKYNPSLKS

SEQ ID NO: 176 - protein, 12 aa, Artificial Sequence
  Synthetic
KKYSTVWSYFDN

SEQ ID NO: 177 - protein, 11 aa, Artificial Sequence
  Synthetic
SGDKLGDKYAS

SEQ ID NO: 178 - protein, 7 aa, Artificial Sequence
  Synthetic
QDRKRPS

SEQ ID NO: 179 - protein, 9 aa, Artificial Sequence
  Synthetic
QAWGSSTAV

SEQ ID NO: 180 - protein, 120 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSS

SEQ ID NO: 181 - protein, 106 aa, Artificial Sequence
  Synthetic
SYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 182 - protein, 241 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 183 - protein, 496 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 184 - protein, 984 aa, Artificial Sequence
  Synthetic
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 5 aa, Artificial Sequence
  Synthetic
GYYWS

SEQ ID NO: 186 - protein, 16 aa, Artificial Sequence
  Synthetic
DIDQSGSTKYNPSLKS

SEQ ID NO: 187 - protein, 12 aa, Artificial Sequence
  Synthetic
KKYSTVWSYFDY

SEQ ID NO: 188 - protein, 11 aa, Artificial Sequence
  Synthetic
SGDKLGDKYAS

SEQ ID NO: 189 - protein, 7 aa, Artificial Sequence
  Synthetic
QDRKRPS

SEQ ID NO: 190 - protein, 9 aa, Artificial Sequence
  Synthetic
QAWGSSTAV

SEQ ID NO: 191 - protein, 120 aa, Artificial Sequence; identical to SEQ ID NO: 169
  Synthetic

SEQ ID NO: 192 - protein, 106 aa, Artificial Sequence; identical to SEQ ID NO: 181
  Synthetic

SEQ ID NO: 193 - protein, 241 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 194 - protein, 496 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 195 - protein, 984 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 5 aa, Artificial Sequence
  Synthetic
SYGMH

SEQ ID NO: 197 - protein, 17 aa, Artificial Sequence
  Synthetic
VIWYSGSNKYYATSVKG

SEQ ID NO: 198 - protein, 9 aa, Artificial Sequence
  Synthetic
GAYTYGFDY

SEQ ID NO: 199 - protein, 11 aa, Artificial Sequence
  Synthetic
RASQSINRYLA

SEQ ID NO: 200 - protein, 7 aa, Artificial Sequence
  Synthetic
TASNRAT

SEQ ID NO: 201 - protein, 9 aa, Artificial Sequence
  Synthetic
HHYGSSIFT

SEQ ID NO: 202 - protein, 118 aa, Artificial Sequence
  Synthetic
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSS

SEQ ID NO: 203 - protein, 107 aa, Artificial Sequence
  Synthetic
EIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 204 - protein, 240 aa, Artificial Sequence
  Synthetic
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 205 - protein, 495 aa, Artificial Sequence
  Synthetic
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 206 - protein, 983 aa, Artificial Sequence
  Synthetic
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 5 aa, Artificial Sequence
  Synthetic
SYGMH

SEQ ID NO: 208 - protein, 17 aa, Artificial Sequence
  Synthetic
VIWFDASNKYYAESVKG

SEQ ID NO: 209 - protein, 9 aa, Artificial Sequence
  Synthetic
GAYTYGFDY

SEQ ID NO: 210 - protein, 11 aa, Artificial Sequence
  Synthetic
RASQSINRYLA

SEQ ID NO: 211 - protein, 7 aa, Artificial Sequence
  Synthetic
TASNRAT

SEQ ID NO: 212 - protein, 9 aa, Artificial Sequence
  Synthetic
HHYGSSIFT

SEQ ID NO: 213 - protein, 118 aa, Artificial Sequence
  Synthetic
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSS

SEQ ID NO: 214 - protein, 107 aa, Artificial Sequence; identical to SEQ ID NO: 203
  Synthetic

SEQ ID NO: 215 - protein, 240 aa, Artificial Sequence
  Synthetic
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 216 - protein, 495 aa, Artificial Sequence
  Synthetic
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 217 - protein, 983 aa, Artificial Sequence
  Synthetic
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 5 aa, Artificial Sequence
  Synthetic
SYGMH

SEQ ID NO: 219 - protein, 17 aa, Artificial Sequence
  Synthetic
VIWFQGSNKYYADAVKG

SEQ ID NO: 220 - protein, 9 aa, Artificial Sequence
  Synthetic
GGYTYGFDY

SEQ ID NO: 221 - protein, 11 aa, Artificial Sequence
  Synthetic
RASQSINRYLA

SEQ ID NO: 222 - protein, 7 aa, Artificial Sequence
  Synthetic
TASNRAT

SEQ ID NO: 223 - protein, 9 aa, Artificial Sequence
  Synthetic
HHYGSSIFT

SEQ ID NO: 224 - protein, 118 aa, Artificial Sequence
  Synthetic
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSS

SEQ ID NO: 225 - protein, 107 aa, Artificial Sequence; identical to SEQ ID NO: 203
  Synthetic

SEQ ID NO: 226 - protein, 240 aa, Artificial Sequence
  Synthetic
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 227 - protein, 495 aa, Artificial Sequence
  Synthetic
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 228 - protein, 983 aa, Artificial Sequence
  Synthetic
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 7 aa, Artificial Sequence
  Synthetic
SGGYNWA

SEQ ID NO: 230 - protein, 16 aa, Artificial Sequence
  Synthetic
YIYYSGSTYYNPSLKS

SEQ ID NO: 231 - protein, 12 aa, Artificial Sequence
  Synthetic
EKYSSRWTFFDY

SEQ ID NO: 232 - protein, 11 aa, Artificial Sequence
  Synthetic
SGDKLGDNYAS

SEQ ID NO: 233 - protein, 7 aa, Artificial Sequence
  Synthetic
HDNKRPS

SEQ ID NO: 234 - protein, 9 aa, Artificial Sequence
  Synthetic
QAFQSSTVV

SEQ ID NO: 235 - protein, 122 aa, Artificial Sequence
  Synthetic
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSS

SEQ ID NO: 236 - protein, 106 aa, Artificial Sequence
  Synthetic
SYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVL

SEQ ID NO: 237 - protein, 243 aa, Artificial Sequence
  Synthetic
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVL

SEQ ID NO: 238 - protein, 498 aa, Artificial Sequence
  Synthetic
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 239 - protein, 986 aa, Artificial Sequence
  Synthetic
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 5 aa, Artificial Sequence
  Synthetic
NFGMH

SEQ ID NO: 241 - protein, 17 aa, Artificial Sequence
  Synthetic
VIWFDASKTYYAEAVKG

SEQ ID NO: 242 - protein, 12 aa, Artificial Sequence
  Synthetic
ATYSTGWSYFDY

SEQ ID NO: 243 - protein, 11 aa, Artificial Sequence
  Synthetic
SGDKLGDKYTS

SEQ ID NO: 244 - protein, 7 aa, Artificial Sequence
  Synthetic
HDAKRPS

SEQ ID NO: 245 - protein, 10 aa, Artificial Sequence
  Synthetic
QAYEASTAWV

SEQ ID NO: 246 - protein, 121 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSS

SEQ ID NO: 247 - protein, 107 aa, Artificial Sequence
  Synthetic
SYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVL

SEQ ID NO: 248 - protein, 243 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVL

SEQ ID NO: 249 - protein, 498 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 250 - protein, 986 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 5 aa, Artificial Sequence
  Synthetic
NFGMH

SEQ ID NO: 252 - protein, 17 aa, Artificial Sequence
  Synthetic
VIWFDASKTYYAESVKG

SEQ ID NO: 253 - protein, 12 aa, Artificial Sequence
  Synthetic
ATYSTGWSYFDY

SEQ ID NO: 254 - protein, 11 aa, Artificial Sequence
  Synthetic
SGDKLGDKYTS

SEQ ID NO: 255 - protein, 7 aa, Artificial Sequence
  Synthetic
HDAKRPS

SEQ ID NO: 256 - protein, 10 aa, Artificial Sequence
  Synthetic
QAWEASTAWV

SEQ ID NO: 257 - protein, 121 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSS

SEQ ID NO: 258 - protein, 107 aa, Artificial Sequence
  Synthetic
SYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVL

SEQ ID NO: 259 - protein, 243 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVL

SEQ ID NO: 260 - protein, 498 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 261 - protein, 986 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 5 aa, Artificial Sequence
  Synthetic
NFGMH

SEQ ID NO: 263 - protein, 17 aa, Artificial Sequence
  Synthetic
VIWFDASKTYYADAVKG

SEQ ID NO: 264 - protein, 12 aa, Artificial Sequence
  Synthetic
ATYSTGWSYFDY

SEQ ID NO: 265 - protein, 11 aa, Artificial Sequence
  Synthetic
SGDKLGDKYTS

SEQ ID NO: 266 - protein, 7 aa, Artificial Sequence
  Synthetic
HDAKRPS

SEQ ID NO: 267 - protein, 10 aa, Artificial Sequence
  Synthetic
QAWDASTAWV

SEQ ID NO: 268 - protein, 121 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSS

SEQ ID NO: 269 - protein, 107 aa, Artificial Sequence; identical to SEQ ID NO: 71
  Synthetic

SEQ ID NO: 270 - protein, 243 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVL

SEQ ID NO: 271 - protein, 498 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 272 - protein, 986 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 273 - protein, 5 aa, Artificial Sequence
  Synthetic
NFGMH

SEQ ID NO: 274 - protein, 17 aa, Artificial Sequence
  Synthetic
VIWFDASKTYYASSVKG

SEQ ID NO: 275 - protein, 12 aa, Artificial Sequence
  Synthetic
ATYSTGWSYFDY

SEQ ID NO: 276 - protein, 11 aa, Artificial Sequence
  Synthetic
SGDKLGDKYTS

SEQ ID NO: 277 - protein, 7 aa, Artificial Sequence
  Synthetic
HDAKRPS

SEQ ID NO: 278 - protein, 10 aa, Artificial Sequence
  Synthetic
QAYSASTAWV

SEQ ID NO: 279 - protein, 121 aa, Artificial Sequence; identical to SEQ ID NO: 70
  Synthetic

SEQ ID NO: 280 - protein, 107 aa, Artificial Sequence
  Synthetic
SYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVL

SEQ ID NO: 281 - protein, 243 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVL

SEQ ID NO: 282 - protein, 498 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 283 - protein, 986 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 5 aa, Artificial Sequence
  Synthetic
GYYWS

SEQ ID NO: 285 - protein, 16 aa, Artificial Sequence
  Synthetic
DIDYSGSTKYNPSLKS

SEQ ID NO: 286 - protein, 12 aa, Artificial Sequence
  Synthetic
KKYSTVWSYFDY

SEQ ID NO: 287 - protein, 11 aa, Artificial Sequence
  Synthetic
SGDKLGEKYAS

SEQ ID NO: 288 - protein, 7 aa, Artificial Sequence
  Synthetic
QDRKRPS

SEQ ID NO: 289 - protein, 9 aa, Artificial Sequence
  Synthetic
QAWGSSAAV

SEQ ID NO: 290 - protein, 120 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSS

SEQ ID NO: 291 - protein, 106 aa, Artificial Sequence
  Synthetic
SYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVL

SEQ ID NO: 292 - protein, 241 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVL

SEQ ID NO: 293 - protein, 496 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 294 - protein, 984 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 5 aa, Artificial Sequence
  Synthetic
SYGMH

SEQ ID NO: 296 - protein, 17 aa, Artificial Sequence
  Synthetic
VISYDASNKYYASAVKG

SEQ ID NO: 297 - protein, 9 aa, Artificial Sequence
  Synthetic
GAYTYGFDY

SEQ ID NO: 298 - protein, 11 aa, Artificial Sequence
  Synthetic
RASQSVNRYLA

SEQ ID NO: 299 - protein, 7 aa, Artificial Sequence
  Synthetic
GASNRAT

SEQ ID NO: 300 - protein, 9 aa, Artificial Sequence
  Synthetic
HHYGSSIFA

SEQ ID NO: 301 - protein, 118 aa, Artificial Sequence
  Synthetic
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSS

SEQ ID NO: 302 - protein, 107 aa, Artificial Sequence; identical to SEQ ID NO: 38
  Synthetic

SEQ ID NO: 303 - protein, 240 aa, Artificial Sequence
  Synthetic
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 304 - protein, 495 aa, Artificial Sequence
  Synthetic
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 305 - protein, 983 aa, Artificial Sequence
  Synthetic
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 5 aa, Artificial Sequence
  Synthetic
SYGMH

SEQ ID NO: 307 - protein, 17 aa, Artificial Sequence
  Synthetic
VIWFDASNKYYAESVKG

SEQ ID NO: 308 - protein, 9 aa, Artificial Sequence
  Synthetic
GAYTYGFDY

SEQ ID NO: 309 - protein, 11 aa, Artificial Sequence
  Synthetic
RASQSVNRYLA

SEQ ID NO: 310 - protein, 7 aa, Artificial Sequence
  Synthetic
GASNRAT

SEQ ID NO: 311 - protein, 9 aa, Artificial Sequence
  Synthetic
HHYGSSIFA

SEQ ID NO: 312 - protein, 118 aa, Artificial Sequence
  Synthetic
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSS

SEQ ID NO: 313 - protein, 107 aa, Artificial Sequence; identical to SEQ ID NO: 38
  Synthetic

SEQ ID NO: 314 - protein, 240 aa, Artificial Sequence
  Synthetic
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 315 - protein, 495 aa, Artificial Sequence
  Synthetic
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 316 - protein, 983 aa, Artificial Sequence
  Synthetic
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 5 aa, Artificial Sequence
  Synthetic
SYGMH

SEQ ID NO: 318 - protein, 17 aa, Artificial Sequence
  Synthetic
VISYEGSNKYYAESVKG

SEQ ID NO: 319 - protein, 9 aa, Artificial Sequence
  Synthetic
GAYTYGFDY

SEQ ID NO: 320 - protein, 11 aa, Artificial Sequence
  Synthetic
RASQSVNRYLA

SEQ ID NO: 321 - protein, 7 aa, Artificial Sequence
  Synthetic
GASNRAT

SEQ ID NO: 322 - protein, 9 aa, Artificial Sequence
  Synthetic
HHYGSSIFA

SEQ ID NO: 323 - protein, 118 aa, Artificial Sequence
  Synthetic
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSS

SEQ ID NO: 324 - protein, 107 aa, Artificial Sequence; identical to SEQ ID NO: 38
  Synthetic

SEQ ID NO: 325 - protein, 240 aa, Artificial Sequence
  Synthetic
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 326 - protein, 495 aa, Artificial Sequence
  Synthetic
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 327 - protein, 983 aa, Artificial Sequence
  Synthetic
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - protein, 5 aa, Artificial Sequence
  Synthetic
NFGMH

SEQ ID NO: 329 - protein, 17 aa, Artificial Sequence
  Synthetic
VIWFDASKTYYASSVKG

SEQ ID NO: 330 - protein, 12 aa, Artificial Sequence
  Synthetic
ATYSTGWSYFDY

SEQ ID NO: 331 - protein, 11 aa, Artificial Sequence
  Synthetic
SGDKLGDKYTS

SEQ ID NO: 332 - protein, 7 aa, Artificial Sequence
  Synthetic
HDAKRPS

SEQ ID NO: 333 - protein, 10 aa, Artificial Sequence
  Synthetic
QAWSASTAWV

SEQ ID NO: 334 - protein, 121 aa, Artificial Sequence; identical to SEQ ID NO: 70
  Synthetic

SEQ ID NO: 335 - protein, 107 aa, Artificial Sequence
  Synthetic
SYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 336 - protein, 243 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 337 - protein, 498 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 338 - protein, 986 aa, Artificial Sequence
  Synthetic
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 5 aa, Artificial Sequence
  Synthetic
SYGMH

SEQ ID NO: 340 - protein, 17 aa, Artificial Sequence
  Synthetic
VISYDASNKYYASSVKG

SEQ ID NO: 341 - protein, 9 aa, Artificial Sequence
  Synthetic
GAYTYGFDY

SEQ ID NO: 342 - protein, 11 aa, Artificial Sequence
  Synthetic
RASQSVNRYLA

SEQ ID NO: 343 - protein, 7 aa, Artificial Sequence
  Synthetic
GASNRAT

SEQ ID NO: 344 - protein, 9 aa, Artificial Sequence
  Synthetic
HHYGSSIFA

SEQ ID NO: 345 - protein, 118 aa, Artificial Sequence
  Synthetic
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSS

SEQ ID NO: 346 - protein, 107 aa, Artificial Sequence; identical to SEQ ID NO: 38
  Synthetic

SEQ ID NO: 347 - protein, 240 aa, Artificial Sequence
  Synthetic
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 348 - protein, 495 aa, Artificial Sequence
  Synthetic
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 349 - protein, 983 aa, Artificial Sequence
  Synthetic
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - protein, 5 aa, Artificial Sequence
  Synthetic
NFGMH

SEQ ID NO: 351 - protein, 17 aa, Artificial Sequence
  Synthetic
VIWFDASKTYYAESVKG

SEQ ID NO: 352 - protein, 12 aa, Artificial Sequence
  Synthetic
ATYSTGWSYFDY

SEQ ID NO: 353 - protein, 11 aa, Artificial Sequence
  Synthetic
SGDKLGDKYTS

SEQ ID NO: 354 - protein, 7 aa, Artificial Sequence
  Synthetic
HDAKRPS

SEQ ID NO: 355 - protein, 10 aa, Artificial Sequence
  Synthetic
QAWSASTAWV

SEQ ID NO: 356 - protein, 121 aa, Artificial Sequence; identical to SEQ ID NO: 257
  Synthetic

SEQ ID NO: 357 - protein, 107 aa, Artificial Sequence; identical to SEQ ID NO: 335
  Synthetic

SEQ ID NO: 358 - protein, 243 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 359 - protein, 498 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 360 - protein, 986 aa, Artificial Sequence
  Synthetic
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 5 aa, Artificial Sequence
  Synthetic
NFGMH

SEQ ID NO: 362 - protein, 17 aa, Artificial Sequence
  Synthetic
VIWFDASKTYYADAVKG

SEQ ID NO: 363 - protein, 12 aa, Artificial Sequence
  Synthetic
ATYSTGWSYFDY

SEQ ID NO: 364 - protein, 11 aa, Artificial Sequence
  Synthetic
SGDKLGDKYTS

SEQ ID NO: 365 - protein, 7 aa, Artificial Sequence
  Synthetic
HDAKRPS

SEQ ID NO: 366 - protein, 10 aa, Artificial Sequence
  Synthetic
QAWSASTAWV

SEQ ID NO: 367 - protein, 121 aa, Artificial Sequence; identical to SEQ ID NO: 268
  Synthetic

SEQ ID NO: 368 - protein, 107 aa, Artificial Sequence; identical to SEQ ID NO: 335
  Synthetic

SEQ ID NO: 369 - protein, 243 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 370 - protein, 498 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 371 - protein, 986 aa, Artificial Sequence
  Synthetic
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 372 - protein, 5 aa, Artificial Sequence
  Synthetic
SYGMH

SEQ ID NO: 373 - protein, 17 aa, Artificial Sequence
  Synthetic
VIWYSGSNKYYATSVKG

SEQ ID NO: 374 - protein, 9 aa, Artificial Sequence
  Synthetic
GGYTYGFDY

SEQ ID NO: 375 - protein, 11 aa, Artificial Sequence
  Synthetic
RASQSINRYLA

SEQ ID NO: 376 - protein, 7 aa, Artificial Sequence
  Synthetic
TASNRAT

SEQ ID NO: 377 - protein, 9 aa, Artificial Sequence
  Synthetic
HHYGSSIFT

SEQ ID NO: 378 - protein, 118 aa, Artificial Sequence
  Synthetic
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSS

SEQ ID NO: 379 - protein, 107 aa, Artificial Sequence; identical to SEQ ID NO: 203
  Synthetic

SEQ ID NO: 380 - protein, 240 aa, Artificial Sequence
  Synthetic
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 381 - protein, 495 aa, Artificial Sequence
  Synthetic
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 382 - protein, 983 aa, Artificial Sequence
  Synthetic
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 5 aa, Artificial Sequence
  Synthetic
SYGMH

SEQ ID NO: 384 - protein, 17 aa, Artificial Sequence
  Synthetic
VIWFDASNKYYAESVKG

SEQ ID NO: 385 - protein, 9 aa, Artificial Sequence
  Synthetic
GGYTYGFDY

SEQ ID NO: 386 - protein, 11 aa, Artificial Sequence
  Synthetic
RASQSINRYLA

SEQ ID NO: 387 - protein, 7 aa, Artificial Sequence
  Synthetic
TASNRAT

SEQ ID NO: 388 - protein, 9 aa, Artificial Sequence
  Synthetic
HHYGSSIFT

SEQ ID NO: 389 - protein, 118 aa, Artificial Sequence
  Synthetic
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSS

SEQ ID NO: 390 - protein, 107 aa, Artificial Sequence; identical to SEQ ID NO: 203
  Synthetic

SEQ ID NO: 391 - protein, 240 aa, Artificial Sequence
  Synthetic
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 392 - protein, 495 aa, Artificial Sequence
  Synthetic
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 393 - protein, 983 aa, Artificial Sequence
  Synthetic
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 5 aa, Artificial Sequence
  Synthetic
SYGMH

SEQ ID NO: 395 - protein, 17 aa, Artificial Sequence
  Synthetic
VIWYTGSNKYYAHSVKG

SEQ ID NO: 396 - protein, 9 aa, Artificial Sequence
  Synthetic
GAYTYGFDY

SEQ ID NO: 397 - protein, 11 aa, Artificial Sequence
  Synthetic
RASQSINRYLA

SEQ ID NO: 398 - protein, 7 aa, Artificial Sequence
  Synthetic
TASNRAT

SEQ ID NO: 399 - protein, 9 aa, Artificial Sequence
  Synthetic
HHYGSSIFT

SEQ ID NO: 400 - protein, 118 aa, Artificial Sequence
  Synthetic
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSS

SEQ ID NO: 401 - protein, 107 aa, Artificial Sequence; identical to SEQ ID NO: 203
  Synthetic

SEQ ID NO: 402 - protein, 240 aa, Artificial Sequence
  Synthetic
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 403 - protein, 495 aa, Artificial Sequence
  Synthetic
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 404 - protein, 983 aa, Artificial Sequence
  Synthetic
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 5 aa, Artificial Sequence
  Synthetic
NHGMH

SEQ ID NO: 406 - protein, 17 aa, Artificial Sequence
  Synthetic
GIWSDASNKYYAEAVKG

SEQ ID NO: 407 - protein, 12 aa, Artificial Sequence
  Synthetic
ATYTTGWSYFDY

SEQ ID NO: 408 - protein, 11 aa, Artificial Sequence
  Synthetic
SGDKLGDKYTS

SEQ ID NO: 409 - protein, 7 aa, Artificial Sequence
  Synthetic
HDRKRPS

SEQ ID NO: 410 - protein, 10 aa, Artificial Sequence
  Synthetic
QAYDRSTAWV

SEQ ID NO: 411 - protein, 121 aa, Artificial Sequence
  Synthetic
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSS

SEQ ID NO: 412 - protein, 107 aa, Artificial Sequence
  Synthetic
SYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVL

SEQ ID NO: 413 - protein, 243 aa, Artificial Sequence
  Synthetic
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSSGGGGSGGGGSGGGGSSYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVL

SEQ ID NO: 414 - protein, 498 aa, Artificial Sequence
  Synthetic
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSSGGGGSGGGGSGGGGSSYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 415 - protein, 986 aa, Artificial Sequence
  Synthetic
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSSGGGGSGGGGSGGGGSSYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - protein, 5 aa, Artificial Sequence
  Synthetic
NHGMH

SEQ ID NO: 417 - protein, 17 aa, Artificial Sequence
  Synthetic
GIWSEGSNKYYADAVKG

SEQ ID NO: 418 - protein, 12 aa, Artificial Sequence
  Synthetic
ATYTTGWSYFDY

SEQ ID NO: 419 - protein, 11 aa, Artificial Sequence
  Synthetic
SGDKLGDKYAS

SEQ ID NO: 420 - protein, 7 aa, Artificial Sequence
  Synthetic
QDAKRPS

SEQ ID NO: 421 - protein, 9 aa, Artificial Sequence
  Synthetic
QAFHQSTWV

SEQ ID NO: 422 - protein, 121 aa, Artificial Sequence
  Synthetic
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSS

SEQ ID NO: 423 - protein, 106 aa, Artificial Sequence
  Synthetic
SYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL

SEQ ID NO: 424 - protein, 242 aa, Artificial Sequence
  Synthetic
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL

SEQ ID NO: 425 - protein, 497 aa, Artificial Sequence
  Synthetic
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 426 - protein, 985 aa, Artificial Sequence
  Synthetic
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - protein, 5 aa, Artificial Sequence
  Synthetic
SFGMH

SEQ ID NO: 428 - protein, 17 aa, Artificial Sequence
  Synthetic
VIWFDASNKYYAESVKG

SEQ ID NO: 429 - protein, 9 aa, Artificial Sequence
  Synthetic
GGYTYGFDY

SEQ ID NO: 430 - protein, 11 aa, Artificial Sequence
  Synthetic
RASQAINRYLA

SEQ ID NO: 431 - protein, 7 aa, Artificial Sequence
  Synthetic
GASSRAT

SEQ ID NO: 432 - protein, 9 aa, Artificial Sequence
  Synthetic
QHYGSSIFT

SEQ ID NO: 433 - protein, 118 aa, Artificial Sequence; identical to SEQ ID NO: 103
  Synthetic

SEQ ID NO: 434 - protein, 107 aa, Artificial Sequence
  Synthetic
EIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIK

SEQ ID NO: 435 - protein, 240 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIK

SEQ ID NO: 436 - protein, 495 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 437 - protein, 983 aa, Artificial Sequence
  Synthetic
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 438 - protein, 5 aa, Artificial Sequence
  Synthetic
SYGMH

SEQ ID NO: 439 - protein, 17 aa, Artificial Sequence
  Synthetic
VIWYDASNKYYATSVKG

SEQ ID NO: 440 - protein, 9 aa, Artificial Sequence
  Synthetic
GGYTYGFDY

SEQ ID NO: 441 - protein, 11 aa, Artificial Sequence
  Synthetic
RASQSINRYLA

SEQ ID NO: 442 - protein, 7 aa, Artificial Sequence
  Synthetic
TASNRAT

SEQ ID NO: 443 - protein, 9 aa, Artificial Sequence
  Synthetic
HHYGSSIFT

SEQ ID NO: 444 - protein, 118 aa, Artificial Sequence
  Synthetic
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSS

SEQ ID NO: 445 - protein, 107 aa, Artificial Sequence; identical to SEQ ID NO: 203
  Synthetic

SEQ ID NO: 446 - protein, 240 aa, Artificial Sequence
  Synthetic
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 447 - protein, 495 aa, Artificial Sequence
  Synthetic
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 448 - protein, 983 aa, Artificial Sequence
  Synthetic
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 5 aa, Artificial Sequence
  Synthetic
SYGMH

SEQ ID NO: 450 - protein, 17 aa, Artificial Sequence
  Synthetic
VIWFHGSNKYYAESVKG

SEQ ID NO: 451 - protein, 9 aa, Artificial Sequence
  Synthetic
GAYTYGFDY

SEQ ID NO: 452 - protein, 11 aa, Artificial Sequence
  Synthetic
RASQSINRYLA

SEQ ID NO: 453 - protein, 7 aa, Artificial Sequence
  Synthetic
TASNRAT

SEQ ID NO: 454 - protein, 9 aa, Artificial Sequence
  Synthetic
HHYGSSIFT

SEQ ID NO: 455 - protein, 118 aa, Artificial Sequence
  Synthetic
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSS

SEQ ID NO: 456 - protein, 107 aa, Artificial Sequence; identical to SEQ ID NO: 203
  Synthetic

SEQ ID NO: 457 - protein, 240 aa, Artificial Sequence
  Synthetic
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 458 - protein, 495 aa, Artificial Sequence
  Synthetic
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 459 - protein, 983 aa, Artificial Sequence
  Synthetic
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 460 - protein, 5 aa, Artificial Sequence
  Synthetic
NFGMH

SEQ ID NO: 461 - protein, 17 aa, Artificial Sequence
  Synthetic
VIWFDASKTYYAEAVKG

SEQ ID NO: 462 - protein, 12 aa, Artificial Sequence
  Synthetic
ATYSTGWSYFDY

SEQ ID NO: 463 - protein, 11 aa, Artificial Sequence
  Synthetic
SGDKLGDKYTS

SEQ ID NO: 464 - protein, 7 aa, Artificial Sequence
  Synthetic
HDAKRPS

SEQ ID NO: 465 - protein, 10 aa, Artificial Sequence
  Synthetic
QAWSASTAWV

SEQ ID NO: 466 - protein, 121 aa, Artificial Sequence; identical to SEQ ID NO: 246
  Synthetic

SEQ ID NO: 467 - protein, 107 aa, Artificial Sequence; identical to SEQ ID NO: 335
  Synthetic

SEQ ID NO: 468 - protein, 243 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 469 - protein, 498 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 470 - protein, 986 aa, Artificial Sequence
  Synthetic
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 471 - protein, 5 aa, Artificial Sequence
  Synthetic
GYYWS

SEQ ID NO: 472 - protein, 16 aa, Artificial Sequence
  Synthetic
DIDYSGSTKYNPSLKS

SEQ ID NO: 473 - protein, 12 aa, Artificial Sequence
  Synthetic
KKYSTVWSYFDY

SEQ ID NO: 474 - protein, 11 aa, Artificial Sequence
  Synthetic
SGDKLGDKYAN

SEQ ID NO: 475 - protein, 7 aa, Artificial Sequence
  Synthetic
HDNKRPS

SEQ ID NO: 476 - protein, 9 aa, Artificial Sequence
  Synthetic
QAYGISSAV

SEQ ID NO: 477 - protein, 120 aa, Artificial Sequence; identical to SEQ ID NO: 290
  Synthetic

SEQ ID NO: 478 - protein, 106 aa, Artificial Sequence
  Synthetic
SYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVL

SEQ ID NO: 479 - protein, 241 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVL

SEQ ID NO: 480 - protein, 496 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 481 - protein, 984 aa, Artificial Sequence
  Synthetic
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 5 aa, Artificial Sequence
  Synthetic
GYYWS

SEQ ID NO: 483 - protein, 16 aa, Artificial Sequence
  Synthetic
DIDQSGSTKYNPSLKS

SEQ ID NO: 484 - protein, 12 aa, Artificial Sequence
  Synthetic
KKYSTVWSYFDY

SEQ ID NO: 485 - protein, 11 aa, Artificial Sequence
  Synthetic
SGDKLGDKYAS

SEQ ID NO: 486 - protein, 7 aa, Artificial Sequence
  Synthetic
QDRKRPS

SEQ ID NO: 487 - protein, 9 aa, Artificial Sequence
  Synthetic
QAWGSSAAV

SEQ ID NO: 488 - protein, 120 aa, Artificial Sequence; identical to SEQ ID NO: 169
  Synthetic

SEQ ID NO: 489 - protein, 106 aa, Artificial Sequence
  Synthetic
SYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 490 - protein, 241 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 491 - protein, 496 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 492 - protein, 984 aa, Artificial Sequence
  Synthetic
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 5 aa, Artificial Sequence
  Synthetic
SFGMH

SEQ ID NO: 494 - protein, 17 aa, Artificial Sequence
  Synthetic
VIWYTGSNKYYASSVKG

SEQ ID NO: 495 - protein, 9 aa, Artificial Sequence
  Synthetic
GGYTYGFDY

SEQ ID NO: 496 - protein, 11 aa, Artificial Sequence
  Synthetic
RASQSINRYLA

SEQ ID NO: 497 - protein, 7 aa, Artificial Sequence
  Synthetic
TASNRAT

SEQ ID NO: 498 - protein, 9 aa, Artificial Sequence
  Synthetic
HHYGSSIFT

SEQ ID NO: 499 - protein, 118 aa, Artificial Sequence
  Synthetic
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSS

SEQ ID NO: 500 - protein, 107 aa, Artificial Sequence; identical to SEQ ID NO: 203
  Synthetic

SEQ ID NO: 501 - protein, 240 aa, Artificial Sequence
  Synthetic
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 502 - protein, 495 aa, Artificial Sequence
  Synthetic
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 503 - protein, 983 aa, Artificial Sequence
  Synthetic
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 504 - protein, 5 aa, Artificial Sequence
  Synthetic
SYGMH

SEQ ID NO: 505 - protein, 17 aa, Artificial Sequence
  Synthetic
VIWFDASNKYYAESVKG

SEQ ID NO: 506 - protein, 9 aa, Artificial Sequence
  Synthetic
GGYTYGFDY

SEQ ID NO: 507 - protein, 11 aa, Artificial Sequence
  Synthetic
RASQSINRYLA

SEQ ID NO: 508 - protein, 7 aa, Artificial Sequence
  Synthetic
TASNRAT

SEQ ID NO: 509 - protein, 9 aa, Artificial Sequence
  Synthetic
HHYGSSIFT

SEQ ID NO: 510 - protein, 118 aa, Artificial Sequence
  Synthetic
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSS

SEQ ID NO: 511 - protein, 107 aa, Artificial Sequence; identical to SEQ ID NO: 203
  Synthetic

SEQ ID NO: 512 - protein, 240 aa, Artificial Sequence
  Synthetic
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 513 - protein, 495 aa, Artificial Sequence
  Synthetic
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 514 - protein, 983 aa, Artificial Sequence
  Synthetic
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 515 - protein, 5 aa, Artificial Sequence
  Synthetic
SYGMH

SEQ ID NO: 516 - protein, 17 aa, Artificial Sequence
  Synthetic
VIWYDASNKYYATSVKG

SEQ ID NO: 517 - protein, 9 aa, Artificial Sequence
  Synthetic
GGYTYGFDY

SEQ ID NO: 518 - protein, 11 aa, Artificial Sequence
  Synthetic
RASQSINRYLA

SEQ ID NO: 519 - protein, 7 aa, Artificial Sequence
  Synthetic
TASNRAT

SEQ ID NO: 520 - protein, 9 aa, Artificial Sequence
  Synthetic
HHYGSSIFT

SEQ ID NO: 521 - protein, 118 aa, Artificial Sequence
  Synthetic
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSS

SEQ ID NO: 522 - protein, 107 aa, Artificial Sequence; identical to SEQ ID NO: 203
  Synthetic

SEQ ID NO: 523 - protein, 240 aa, Artificial Sequence
  Synthetic
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 524 - protein, 495 aa, Artificial Sequence
  Synthetic
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 525 - protein, 983 aa, Artificial Sequence
  Synthetic
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 126 aa, Artificial Sequence
  Synthetic
EVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCF

SEQ ID NO: 527 - protein, 107 aa, Artificial Sequence
  Synthetic
SAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICS

SEQ ID NO: 528 - protein, 113 aa, Artificial Sequence
  Synthetic
RTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLG

SEQ ID NO: 529 - protein, 146 aa, Artificial Sequence
  Synthetic
SVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKS

SEQ ID NO: 530 - protein, 220 aa, Artificial Sequence
  Synthetic
EVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSL

SEQ ID NO: 531 - protein, 207 aa, Artificial Sequence
  Synthetic
ISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSL

SEQ ID NO: 532 - protein, 99 aa, Artificial Sequence
  Synthetic
DMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSL

SEQ ID NO: 533 - protein, 50 aa, Artificial Sequence
  Synthetic
SPCEPGFSVSKNCNLGKCQMSLSGPQCLCVTTETHWYSGETCNQGTQKSL

The invention claimed is:

1. An antibody that binds human mucin 17 (MUC17) comprising the amino acid sequence set forth in SEQ ID NO: 1, wherein the antibody comprises a variable heavy chain comprising a CDR1 region, a CDR2 region, and a CDR3 region comprising the amino acid sequences set forth in SEQ ID NOs: 2, 3, and 4, respectively, and a variable light chain region comprising a CDR1 region, a CDR2 region, and a CDR3 region comprising the amino acid sequences set forth in SEQ ID NOs: 6, 7, and 8, respectively.

2. The antibody of claim 1, wherein the antibody comprises a VH region comprising the amino acid sequence set forth in SEQ ID NO: 5 and/or a VL region comprising the amino acid sequence set forth in SEQ ID NO: 9.

3. The antibody of claim 1, wherein the antibody is a monoclonal antibody.

4. The antibody of claim 1 which is an IgG1, IgG2, IgG3 or IgG4 antibody.

5. A polynucleotide encoding the antibody of claim 1.

6. A vector comprising the polynucleotide of claim 5.

7. A host cell transformed or transfected with the polynucleotide of claim 6.

8. A process for producing an antibody that binds human mucin 17 (MUC17) protein, the process comprising culturing the host cell of claim 7 under conditions allowing the expression of the antibody and recovering the antibody from the culture.

9. A composition comprising the antibody of claim 1 in a formulation comprising one or more carriers, stabilizers, excipients, diluents, solubilizers, surfactants emulsifiers, preservatives and/or adjuvants.

10. A detection system comprising the antibody of claim 1 and a secondary antibody coupled with a detectable label which is capable of binding to the anti-mucin antibody.

11. A method for detecting mucin 17 (MUC17) MUC17 expression in a biological sample comprising:

(a) contacting the sample with an effective amount of the antibody of claim 1 and a detectable label that binds the antibody; and (b) detecting MUC17 expression in the sample when the detectable label is present.

12. A kit comprising the antibody of claim 1 and various reagents for carrying out an assay to detect and/or quantify the presence of mucin 17 (MUC17) in a biological sample.

* * * * *